(12) United States Patent
Møller et al.

(10) Patent No.: US 11,542,501 B2
(45) Date of Patent: Jan. 3, 2023

(54) ANTISENSE OLIGONUCLEOTIDES TARGETING ATXN3

(71) Applicant: HOFFMANN-LA ROCHE INC., Little Falls, NJ (US)

(72) Inventors: Marianne Ravn Møller, Kgs. Lyngby (DK); Heidi Rye Hudlebusch, Brønshøj (DK); Lykke Pedersen, Copenhagen NV (DK); Erik Daa Funder, Hilleroed (DK); Christoffer Sondergaard, Horsholm (DK); Jette Dam Hedegaard, Horsholm (DK); Alexander Herbert Stephan, Riehen (CH); Peter Hagedorn, Hørsholm (DK)

(73) Assignee: HOFFMANN-LA ROCHE INC., Little Falls, NJ (US)

(*) Notice: Subject to any disclaimer, the term of this patent is extended or adjusted under 35 U.S.C. 154(b) by 0 days.

(21) Appl. No.: 16/946,118

(22) Filed: Jun. 5, 2020

(65) Prior Publication Data
US 2020/0385727 A1 Dec. 10, 2020

(30) Foreign Application Priority Data

Jun. 6, 2019 (EP) .................................... 19178893
Mar. 5, 2020 (EP) .................................... 20161173

(51) Int. Cl.
*C12N 15/113* (2010.01)
*A61P 25/28* (2006.01)

(52) U.S. Cl.
CPC ............. *C12N 15/113* (2013.01); *A61P 25/28* (2018.01); *C12N 2310/11* (2013.01); *C12N 2310/315* (2013.01); *C12N 2310/3231* (2013.01); *C12N 2310/351* (2013.01); *C12N 2320/32* (2013.01)

(58) Field of Classification Search
None
See application file for complete search history.

(56) References Cited

U.S. PATENT DOCUMENTS

| 9,574,191 B2 | 2/2017 | Corey et al. |
| 2018/0258425 A1 | 9/2018 | Rigo et al. |

FOREIGN PATENT DOCUMENTS

| EP | 2742135 A1 | 6/2014 |
| JP | 2015-511821 A | 4/2015 |
| WO | 99/14226 A2 | 3/1999 |
| WO | 2000/047599 A1 | 8/2000 |
| WO | 00/66604 A2 | 11/2000 |
| WO | 01/23613 A1 | 4/2001 |
| WO | 2004/046160 A2 | 6/2004 |
| WO | 2007/031091 A2 | 3/2007 |
| WO | 2007/090071 A2 | 8/2007 |
| WO | 2007/134181 A2 | 11/2007 |
| WO | 2008/049085 A1 | 4/2008 |
| WO | 2008/150729 A2 | 12/2008 |
| WO | 2008/154401 A2 | 12/2008 |
| WO | 2009/006478 A2 | 1/2009 |
| WO | 2009/067647 A1 | 5/2009 |
| WO | 2009/090182 A1 | 7/2009 |
| WO | 2010/036698 A1 | 4/2010 |
| WO | 2010/077578 A1 | 7/2010 |
| WO | 2011/017521 A2 | 2/2011 |
| WO | 2011/097388 A1 | 8/2011 |
| WO | 2011/156202 A1 | 12/2011 |
| WO | 2012/109395 A1 | 8/2012 |
| WO | 2013/022966 A1 | 2/2013 |
| WO | 2013/022984 A1 | 2/2013 |
| WO | 2013/033223 A1 | 3/2013 |
| WO | 2013/138353 A2 | 9/2013 |
| WO | 2013/154798 A1 | 10/2013 |
| WO | 2014/076195 A1 | 5/2014 |
| WO | 2015/017675 A2 | 2/2015 |
| WO | 2015/060722 A1 | 4/2015 |
| WO | 2015/113922 A1 | 8/2015 |
| WO | 2016/126995 A1 | 8/2016 |
| WO | 2017/053781 A1 | 3/2017 |
| WO | 2018/089805 A1 | 5/2018 |
| WO | WO-2019217708 A1 * | 11/2019 | ......... C12N 15/1137 |
| WO | WO-2020172559 A1 * | 8/2020 | ........... A61K 31/712 |

OTHER PUBLICATIONS

Coarelli et al, "Recent advances in understanding dominant spinocerebellar ataxias from clinical and genetic points of view [version 1; referees: 3 approved]", F1000Res. 2018; 7: F1000 Faculty Rev-1781.

Hu Jiaxin et al: "Allele-selective inhibition of ataxin-3 (ATX3) expression by antisense oligomers and duplex RNAs", Biological Chemistry, vol. 392, No. 4, Apr. 1, 2011, pp. 315-325.

Scoles Daniel R. et al, "Antisense oligonucleotides : A primer", Neurology Genetics, vol. 5, No. 2, Apr. 1, 2019 (Apr. 1, 2019), p. e323.

Annie Moisan, "Inhibition of EGF Uptake by Nephrotoxic Antisense Drugs In Vitro and Implications for Preclinical Safety Profiling", Molecular Therapy Nucleic Acids, vol. 6, Mar. 2017, pp. 89-105.

Ansel et al., "Pharmaceutical Dosage Forms and Drug Delivery Systems," Williams & Wilkins, 6th Edition pp. 105-116, 194-200; 1456-1457 (1995) (41 pages).

Bastin, R.J. et al., Salt Selection and Optimisation Procedures for Pharmaceutical New Chemical Entities, Organic Process Research & Development, (2000), vol. 4, pp. 427-435.

Bergstrom DE, "Unnatural nucleosides with unusual base pairing properties", Current Protocols in Nucleic Acid Chemistry, 2009, Suppl. 37 1.4.1, 32 pgs.

(Continued)

*Primary Examiner* — Sean McGarry
(74) *Attorney, Agent, or Firm* — Holland & Hart LLP

(57) ABSTRACT

The present invention relates to antisense LNA oligonucleotides (oligomers) complementary to ATXN3 pre-mRNA sequences, which are capable of inhibiting the expression of ATXN3 protein. Inhibition of ATXN3 expression is beneficial for the treatment of spinocerebellar ataxia.

15 Claims, 10 Drawing Sheets

Figure 1:
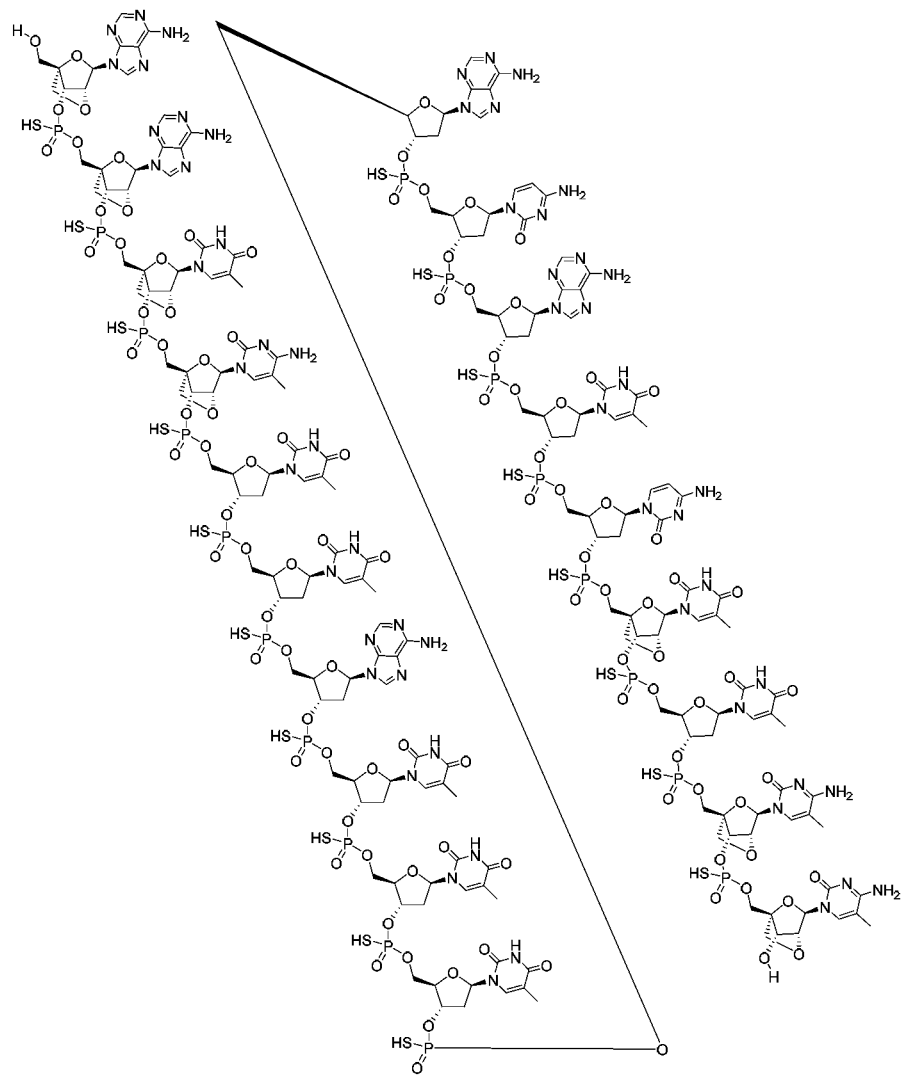

Specification includes a Sequence Listing.

(56) References Cited

OTHER PUBLICATIONS

Caruthers, M.H. et al., Chemical Synthesis of Deoxyoligonucleotides by the Phosphoramidite Method, Methods in Enzymology, 1987, vol. 154, pp. 287-313.
Dieckmann et al, "A Sensitive In Vitro Approach to Assess the Hybridization-Dependent Toxic Potential of High Affinity Gapmer Oligonucleotides", Molecular Therapy: Nucleic Acids vol. 10, Mar. 2018, pp. 45-54.
Eric E Swayze et al, "Antisense oligonucleotides containing locked nucleic acid improve potency but cause significant hepatotoxicity in animals", Nucleic Acids Research, vol. 35, Issue 2, Jan. 15, 2007, pp. 687-700.
Flutter et al., "Filling the Gap in LNA Antisense Oligo Gapmers: The Effects of Unlocked Nucleic Acid (UNA) and 4?-C-Hydroxymethyl-DNA Modifications on Rnase H Recruitment and Efficacy of an LNA Gapmer," Mol Biosyst. 5(8):838-843 (2009) (6 pages).
Freier and Altmann, "The ups and downs of nucleic acid duplex stability: structure-stability studies on chemically-modified DNA:RNA duplexes," Nucleic Acids Res., 1997, 25:4429-4443.
Gennaro et al., "Remington's Pharmaceutical Sciences," Mack Publishing Company. 17th ed., (1985) (9 pages).
Hansen et al., "Entropy titration. A Calorimetric Method for the Determination of t. G0 (K), t. H0 and t..S0 1, "Chemical Communications. 36-38, (1965) (3 pages).
Hirao et al., "Natural versus Artificial Creation of Base Pairs in DNA: Origin of Nucleobases from the Perspectives of Unnatural Base Pair Studies," Ace Chem Res. 45(12): 2055-2065 (2012) (11 pages).
Holdgate et al., "Measurements of Binding Thermodynamics in Drug Discovery," Drug Discov Today. 10(22):1543-1550 (2005) (8 pages).
Langer, R., New Methods of Drug Delivery, Science, 1990, vol. 249, issue 4976, pp. 1527-1533.
Lauren R. Moore et al, "Evaluation of Antisense Oligonucleotides Targeting ATXN3 in SCA3 Mouse Models", Molecular Therapy Nucleic Acids, vol. 7, Jun. 16, 2017, pp. 200-210.
Lodewijk J.A.Toonen et al, Antisense Oligonucleotide-Mediated Removal of the Polyglutamine Repeat in Spinocerebellar Ataxia Type 3 Mice, Molecular Therapy Nucleic Acids, vol. 8, Sep. 15, 2017, pp. 232-242.
Mangos et al., "Efficient RNase H-directed Cleavage of RNA Promoted by Antisense DNA or 2'F-ANA Constructs Containing Acyclic Nucleotide Inserts," J Am Chem Soc. 125(3):654-661 (2003) (8 pages).
McTigue et al., "Sequence-Dependent Thermodynamic Parameters for Locked Nucleic Acid (LNA)-DNA Duplex Formation," Biochemistry. 43(18):5388-5405 (2004) (18 pages).
Mergny et al., "Analysis of Thermal Melting Curves," Oligonucleotides. 13(6):515-537 (2003) (23 pages).
Mitsuoka et al., "A bridged nucleic acid, 2',4'-BNA COC: synthesis of fully modified oligonucleotides bearing thymine, 5 methylcytosine, adenine and guanine 2',4'-BNA COC monomers and RNA-selective nucleic-acid recognition," Nucleic Acids Research, Mar. 2009, 37(4):1225-1238, 14 pgs.
Morita et al., "2'-O,4'-C-Ethylene-Bridged Nucleic Acids (ENA): Highly Nuclease-Resistant and Thermodynamically Stable Oligonucleotides for Antisense Drug," Bioorg Med Chem Lett. 12(1): 73-76 (2002) (4 pages).
Rukov et al., "Dissecting the target specificity of RNase H recruiting oligonucleotides using massively parallel reporter analysis of short RNA motifs," Nucl. Acids Res, Sep. 30, 2015, 43(17):8476-8487.
Sabine Sewing et al, "Assessing single-stranded oligonucleotide drug-induced effects in vitro reveals key risk factors for thrombocytopenia", PLOS One, vol. 12(11): e0187574, Nov. 2017.
Sabine Sewing et al, "Establishment of a Predictive In Vitro Assay for Assessment of the Hepatotoxic Potential of Oligonucleotide Drugs", PLOS One, vol. 11(7), Jul. 2016, e0159431.
Santalucia J Jr., "A Unified View of Polymer, Dumbbell, and Oligonucleotide DNA Nearest- neighbor Thermodynamics," Proc Natl Acad Sci US A. 95(4):1460-1465 (1998) (6 pages).
Seth et al., "Synthesis and Biophysical Evaluation of 2',4'-Constrained 2'0-Methoxyethyl and 2',4'-Constrained 2'0-Ethvl Nucleic Acid Analo!!lles," J. Org. Chem., 2010, 75:1569-1581.
Sugimoto et al., "Thermodynamic Parameters to Predict Stability of RNA/DNA Hybrid Duplexes," Biochemistry. 34(35): 11211-11216 (1995) (6 pages).
Uhlmann E, "Recent advances in the medicinal chemistry of antisense olignonucleotides," Current Opinion in Drug Development, 2000, vol. 3(2), pp. 203-213, 12 pages.
Vester B et al., "Chemically modified oligonucleotides with efficient RNase H response," Bioorganic & Medicinal chemistry Letters, 2008, vol. 18, pp. 2296-2300, 5 pages.
Wan et al., "The Medicinal Chemistry of Therapeutic Oligonucleotides," J Med Chem. 59(21):9645-9667 (2016) (23 pages).

* cited by examiner

1

ANTISENSE OLIGONUCLEOTIDES TARGETING ATXN3

Reference to a Sequence Listing Submitted via EFS-WEB The content of the ASCII text file of the sequence listing named "P35117-Sequence-Listing_103135-0269.txt" which was created on May 20, 2020, and is 612,541 bytes in size submitted electronically via EFS-Web with this U.S. National Phase application is incorporated by reference in its entirety.

CROSS REFERENCE TO RELATED APPLICATIONS

This application is a U.S. Non-provisional and claims priority to European Patent Application No. 19178893.4 filed Jun. 6, 2019, and European Patent Application No. 20161173.8 filed Mar. 5, 2020, the entire disclosures of which are incorporated herein by this reference.

FIELD OF INVENTION

The present invention relates to antisense LNA oligonucleotides (oligomers) complementary to ATXN3 pre-mRNA sequences, which are capable of inhibiting the expression of ATXN3. Inhibition of ATXN3 expression is beneficial for the treatment of spinocerebellar ataxia, such as spinocerebellar ataxia 3 (Machado-Joseph disease (MJD)).

BACKGROUND

Spinocerebellar ataxia type 3 (SCA3), also known as Machado-Joseph disease (MJD), is one of nine polyglutamine expansion diseases and the most common dominantly inherited ataxia in the world. While certain symptoms in SCA3 may respond to symptomatic therapy, there is still no effective treatment for this relentlessly progressive and fatal neurodegenerative disease. The disease is caused by a CAG repeat expansion in the ATXN3 gene that encodes an abnormally long polyglutamine tract in the disease protein, ATXN3 (Ataxin 3). The toxic ataxin-3 protein is associated with aggregates which are frequently observed in the brain tissue of SCA3 patients.

Moore et al. reported that antisense oligonucleotides (ASOs) targeting ATXN3 were capable of reducing levels of the pathogenic ATXN3 protein both in human disease fibroblasts and in a mouse model expressing the full-length human mutant ATXN3 gene (Moore et al., Mol Ther Nucleic Acids. 2017; 7:200-210). Therefore, ASO-mediated targeting of ATXN3 was suggested as therapeutic approach for SCA3.

Swayze et al. (Nucleic Acids Res. 2007; 35(2):687-700. Epub 2006 Dec. 19), reports that antisense oligonucleotides containing locked nucleic acid have the potential to improve potency but cause significant toxicity in animals (hepatotoxicity).

Toonen et al. used antisense oligonucleotides to mask predicted exonic splicing signals of ATXN3, resulting in exon 10 skipping from ATXN3 pre-mRNA. The skipping of exon 10 led to formation of a truncated ataxin-3 protein lacking the toxic polyglutamine expansion, but retaining its ubiquitin binding and cleavage function (Toonen et al., Molecular Therapy—Nucleic Acids, 2017, Volume 8: 232-242).

WO2013/138353, WO2015/017675, WO2018/089805 & WO2019/217708 disclose antisense oligonucleotides targeting human ATXN3 mRNA for use in the treatment of SCA3.

OBJECTIVE OF THE INVENTION

The present invention identifies regions of the ATXN3 transcript (ATXN3) for antisense inhibition in vitro or in vivo, and provides for antisense oligonucleotides, including LNA gapmer oligonucleotides, which target these regions of the ATXN3 premRNA or mature mRNA. The present invention identifies oligonucleotides which inhibit human ATXN3 which are useful in the treatment of spinocerebellar ataxia.

STATEMENT OF THE INVENTION

The invention provides for an antisense oligonucleotide, 10-30 nucleotides in length, targeting a mammalian ATXN3 (Ataxin 3) target nucleic acid, wherein the antisense oligonucleotide is capable of inhibiting the expression of mammalian ATXN3 in a cell which is expressing mammalian ATXN3.

The mammalian ATXN3 target nucleic acid may be, e.g., a human, monkey or mouse ATXN3 target nucleic acid.

The invention provides for an LNA gapmer antisense oligonucleotide, 10-30 nucleotides in length, wherein said antisense oligonucleotide comprises a contiguous nucleotide sequence 10-30 nucleotides in length, wherein the contiguous nucleotide sequence is at least 90% complementary, such as fully complementary, to SEQ ID NO 1, wherein the antisense oligonucleotide is capable of inhibiting the expression of human ATXN3 in a cell which is expressing human ATXN3.

The invention provides for an antisense oligonucleotide which comprises a contiguous nucleotide sequence selected from group consisting of the Oligonucleotide Base Sequences shown in tables 2, 4, 5 and 6, wherein the antisense oligonucleotide is capable of inhibiting the expression of human ATXN3 in a cell which is expressing human ATXN3; or a pharmaceutically acceptable salt thereof.

The invention provides for an LNA gapmer antisense oligonucleotide which comprises a contiguous nucleotide sequence selected from group consisting of the Oligonucleotide Base Sequences shown in tables 2, 4, 5 and 6, wherein the LNA gapmer antisense oligonucleotide is capable of inhibiting the expression of human ATXN3 in a cell which is expressing human ATXN3; or a pharmaceutically acceptable salt thereof.

The invention provides for an antisense oligonucleotide which comprises a contiguous nucleotide sequence SEQ ID NO: 1122, wherein the antisense oligonucleotide is capable of inhibiting the expression of human ATXN3 in a cell which is expressing human ATXN3; or a pharmaceutically acceptable salt thereof.

The invention provides for an antisense oligonucleotide which comprises a contiguous nucleotide sequence SEQ ID NO: 1813, wherein the antisense oligonucleotide is capable of inhibiting the expression of human ATXN3 in a cell which is expressing human ATXN3; or a pharmaceutically acceptable salt thereof.

The invention provides for an antisense oligonucleotide which comprises a contiguous nucleotide sequence SEQ ID NO: 1812, wherein the antisense oligonucleotide is capable of inhibiting the expression of human ATXN3 in a cell which is expressing human ATXN3; or a pharmaceutically acceptable salt thereof.

The invention provides for an antisense oligonucleotide which comprises a contiguous nucleotide sequence SEQ ID NO: 1809, wherein the antisense oligonucleotide is capable of inhibiting the expression of human ATXN3 in a cell which is expressing human ATXN3; or a pharmaceutically acceptable salt thereof.

The invention provides for an antisense oligonucleotide which comprises a contiguous nucleotide sequence SEQ ID NO: 1807, wherein the antisense oligonucleotide is capable of inhibiting the expression of human ATXN3 in a cell which is expressing human ATXN3; or a pharmaceutically acceptable salt thereof.

In some embodiments, the antisense oligonucleotide of the invention is an LNA gapmer antisense oligonucleotide.

The invention provides antisense oligonucleotides according to the invention, such as antisense oligonucleotides 12-24, such as 12-18 in length, nucleosides in length wherein the antisense oligonucleotide comprises a contiguous nucleotide sequence comprising at least 10 contiguous nucleotides present in a sequence selected from the Oligonucleotide Base Sequences shown in tables 2, 4, 5 and 6.

The invention provides antisense oligonucleotides according to the invention, such as antisense oligonucleotides 12-24, such as 12-18 in length, nucleosides in length wherein the antisense oligonucleotide comprises a contiguous nucleotide sequence comprising at least 12 contiguous nucleotides present in a sequence selected from the Oligonucleotide Base Sequences shown in tables 2, 4, 5 and 6.

The invention provides antisense oligonucleotides according to the invention, such as antisense oligonucleotides 12-24, such as 12-18 in length, nucleosides in length wherein the antisense oligonucleotide comprises a contiguous nucleotide sequence comprising at least 14 contiguous nucleotides present in a sequence selected from the Oligonucleotide Base Sequences shown in tables 2, 4, 5 and 6.

The invention provides antisense oligonucleotides according to the invention, such as antisense oligonucleotides 12-24, such as 12-18 in length, nucleosides in length wherein the antisense oligonucleotide comprises a contiguous nucleotide sequence comprising at least 16 contiguous nucleotides present in a sequence selected from the Oligonucleotide Base Sequences shown in tables 2, 4, 5 and 6.

The invention provides antisense oligonucleotides according to the invention, such as antisense oligonucleotides 12-24, such as 12-18 in length, nucleosides in length wherein the antisense oligonucleotide comprises a contiguous nucleotide sequence comprising the contiguous nucleotides present in a sequence selected from the Oligonucleotide Base Sequences shown in tables 2, 4, 5 and 6.

The invention provides antisense oligonucleotides according to the invention, such as antisense oligonucleotides 12-24, such as 12-18 in length, nucleosides in length wherein the antisense oligonucleotide comprises a contiguous nucleotide sequence which is 100% identical to at least 10 contiguous nucleotides present in a sequence selected from SEQ ID NO 4 to SEQ ID NO: 1089; SEQ ID Nos 1099 to 1127; and SEQ ID NO 1137-1988; SEQ ID Nos 1099 to 1127; and SEQ ID NO 1137-1988.

The invention provides antisense oligonucleotides according to the invention, such as antisense oligonucleotides 12-24, such as 12-18 in length, nucleosides in length wherein the antisense oligonucleotide comprises a contiguous nucleotide sequence which is 100% identical to at least 12 contiguous nucleotides present in a sequence selected from SEQ ID NO 4 to SEQ ID NO: 1089; SEQ ID Nos 1099 to 1127; and SEQ ID NO 1137-1988.

The invention provides antisense oligonucleotides according to the invention, such as antisense oligonucleotides 12-24, such as 12-18 in length, nucleosides in length wherein the antisense oligonucleotide comprises a contiguous nucleotide sequence which is 100% identical to at least 14 contiguous nucleotides present in a sequence selected from SEQ ID NO 4 to SEQ ID NO: 1089; SEQ ID Nos 1099 to 1127; and SEQ ID NO 1137-1988.

The invention provides antisense oligonucleotides according to the invention, such as antisense oligonucleotides 12-24, such as 12-18 in length, nucleosides in length wherein the antisense oligonucleotide comprises a contiguous nucleotide sequence which is 100% identical to at least 16 contiguous nucleotides present in a sequence selected from The Oligonucleotide Base Sequences shown in tables 2, 4, 5 and 6.

The invention provides antisense oligonucleotides according to the invention, such as antisense oligonucleotides 12-24, such as 12-18 in length, nucleosides in length wherein the antisense oligonucleotide comprises a contiguous nucleotide sequence which is 100% identical to a sequence selected from The Oligonucleotide Base Sequences shown in tables 2, 4, 5 and 6.

The invention provides for the antisense oligonucleotide disclosed herein, for example an antisense oligonucleotide selected from the group consisting of 1099_1 (SEQ ID NO: 1099), 1100_1 (SEQ ID NO: 1100), 1101_1' (SEQ ID NO: 1101), 1102_1 (SEQ ID NO: 1102), 1103_1 (SEQ ID NO: 1103), 1104_1 (SEQ ID NO: 1104), 1105_1 (SEQ ID NO: 1105), 1106_1 (SEQ ID NO: 1106), 1107_1 (SEQ ID NO: 1107), 1108_1 (SEQ ID NO: 1108), 1109_1 (SEQ ID NO: 1109), 1110_1 (SEQ ID NO: 1110), 1111_1' (SEQ ID NO: 1111), 1112_1 (SEQ ID NO: 1112), 1113_1 (SEQ ID NO: 1113), 1114_1 (SEQ ID NO: 1114), 1115_)1 (SEQ ID NO: 1115), 1116_1 (SEQ ID NO: 1116), 1117_1 (SEQ ID NO: 1117), 1118_1 (SEQ ID NO: 1118), 1119_1 (SEQ ID NO: 1119), 1120_1 (SEQ ID NO: 1120), 1121_1' (SEQ ID NO: 1121), 1122_1 SEQ ID NO: 1122), 1123_1 (SEQ ID NO: 1123), 1124_1 (SEQ ID NO: 1124), 1125_1 (SEQ ID NO: 1125), 1126_1 (SEQ ID NO: 1126), and 1127_1 (SEQ ID NO: 1127).

The invention provides for the antisense oligonucleotide disclosed herein, for example an antisense oligonucleotide selected from the group consisting of the compounds shown in the table in example 2.

The invention provides for the antisense oligonucleotide disclosed herein, for example an antisense oligonucleotide selected from the group consisting of the compounds shown in the table in example 3.

The invention provides for the antisense oligonucleotide disclosed herein, for example an antisense oligonucleotide selected from the group consisting of the compounds shown in the table in example 4.

The invention provides for an antisense oligonucleotide selected from the group consisting of Compound No 1122_62 (SEQ ID NO: 1122), 1122_67 (SEQ ID NO: 1122), 1122_33 (SEQ ID NO: 1122), 1856_1 (SEQ ID NO: 1856), 1813_1 (SEQ ID NO: 1813), 1812_1 (SEQ ID NO: 1812), 1809_2 (SEQ ID NO: 1809), and 1607_1 (SEQ ID NO: 1607), a pharmaceutically acceptable salt thereof.

The invention provides for an antisense oligonucleotide of formula ACCcatattttactCTT (Compound No 1856_1 (SEQ ID NO: 1856)), wherein a capital letter represents a beta-D-oxy LNA nucleoside, a lower case letter represents a DNA nucleoside, wherein each LNA cytosine is 5-methyl cytosine, and wherein the internucleoside linkages between the nucleosides are 10 phosphorothioate internucleoside linkages; or a pharmaceutically acceptable salt thereof.

The invention provides for an antisense oligonucleotide of formula CTGtacacttttacaTT (Compound No 1813_1 (SEQ ID NO: 1813)), wherein a capital letter represents a beta- D-oxy LNA nucleoside, a lower case letter represents a DNA nucleoside, wherein each LNA cytosine is 5-methyl cytosine, and wherein the internucleoside linkages between the nucleosides are phosphorothioate internucleoside linkages; or a pharmaceutically acceptable salt thereof.

The invention provides for an antisense oligonucleotide of formula TGtacacttttacatTCC (Compound No 1812_1 (SEQ ID NO: 1812)), wherein a capital letter represents a beta-D-oxy LNA nucleoside, a lower case letter represents a DNA nucleoside, wherein each LNA cytosine is 5-methyl cytosine, and wherein the internucleoside linkages between the nucleosides are phosphorothioate internucleoside linkages; or a pharmaceutically acceptable salt thereof.

The invention provides for an antisense oligonucleotide of formula GtacacttttacattCCC (Compound No 1809_2 (SEQ ID NO: 1809)), wherein a capital letter represents a beta-D-oxy LNA nucleoside, a lower case letter represents a DNA nucleoside, wherein each LNA cytosine is 5-methyl cytosine, and wherein the internucleoside linkages between the nucleosides are phosphorothioate internucleoside linkages; or a pharmaceutically acceptable salt thereof.

The invention provides for an antisense oligonucleotide of formula TTCttcattataccatCAA (Compound No 1607_1 (SEQ ID NO: 1607)), wherein a capital letter represents a beta-D-oxy LNA nucleoside, a lower case letter represents a DNA nucleoside, wherein each LNA cytosine is 5-methyl cytosine, and wherein the internucleoside linkages between the nucleosides are phosphorothioate internucleoside linkages; or a pharmaceutically acceptable salt thereof.

The invention provides for an antisense oligonucleotide of formula AatCtTatttacatcTtCC (Compound No 1122_62 (SEQ ID NO: 1122)), wherein a capital letter represents a beta-D-oxy LNA nucleoside, a lower case letter represents a DNA nucleoside, wherein each LNA cytosine is 5-methyl cytosine, and wherein the internucleoside linkages between the nucleosides are 5 phosphorothioate internucleoside linkages; or a pharmaceutically acceptable salt thereof.

The invention provides for an antisense oligonucleotide of formula AATCttatttacatcTtCC (Compound No 1122_67 (SEQ ID NO: 1122)), wherein a capital letter represents a beta-D-oxy LNA nucleoside, a lower case letter represents a DNA nucleoside, wherein each LNA cytosine is 5-methyl 10 cytosine, and wherein the internucleoside linkages between the nucleosides are phosphorothioate internucleoside linkages; or a pharmaceutically acceptable salt thereof.

The invention provides for an antisense oligonucleotide of formula AatCtTatttacatctTCC (Compound No 1122_33 (SEQ ID NO: 1122)), wherein a capital letter represents a beta-D-oxy LNA nucleoside, a lower case letter represents a DNA nucleoside, wherein each LNA cytosine is 5-methyl cytosine, and wherein the internucleoside linkages between the nucleosides are phosphorothioate internucleoside linkages; or a pharmaceutically acceptable salt thereof.

The oligonucleotide of the invention as referred to or claimed herein may be in the form of a pharmaceutically acceptable salt, such as a sodium of potassium salt.

The invention provides for a conjugate comprising the oligonucleotide according to the invention, and at least one conjugate moiety covalently attached to said oligonucleotide. The invention provides for a pharmaceutical composition comprising the oligonucleotide or conjugate of the invention and a pharmaceutically acceptable diluent, solvent, carrier, salt and/or adjuvant.

The invention provides for an in vivo or in vitro method for modulating ATXN3 expression in a target cell which is expressing ATXN3, said method comprising administering an oligonucleotide or conjugate or pharmaceutical composition of the invention in an effective amount to said cell.

The invention provides for a method for treating or preventing a disease comprising administering a therapeutically or prophylactically effective amount of an oligonucleotide, conjugate or the pharmaceutical composition of the invention to a subject suffering from or susceptible to the disease.

In some embodiments, the disease is spinocerebellar ataxia, such as spinocerebellar ataxia 3, such as Machado-Joseph disease (MJD).

The invention provides for the oligonucleotide, conjugate or the pharmaceutical composition of the invention for use in medicine.

The invention provides for the oligonucleotide, conjugate or the pharmaceutical composition of the invention for use in the treatment or prevention of spinocerebellar ataxia, such as spinocerebellar ataxia 3, such as Machado-Joseph disease (MJD).

The invention provides for the use of the oligonucleotide, conjugate or the pharmaceutical composition of the invention, for the preparation of a medicament for treatment or prevention of spinocerebellar ataxia, such as spinocerebellar ataxia 3 such as Machado-Joseph disease (MJD).

FIGURES

FIG. 1: Drawing of compound 1122_67 (SEQ ID NO 1122).

Figure 2:
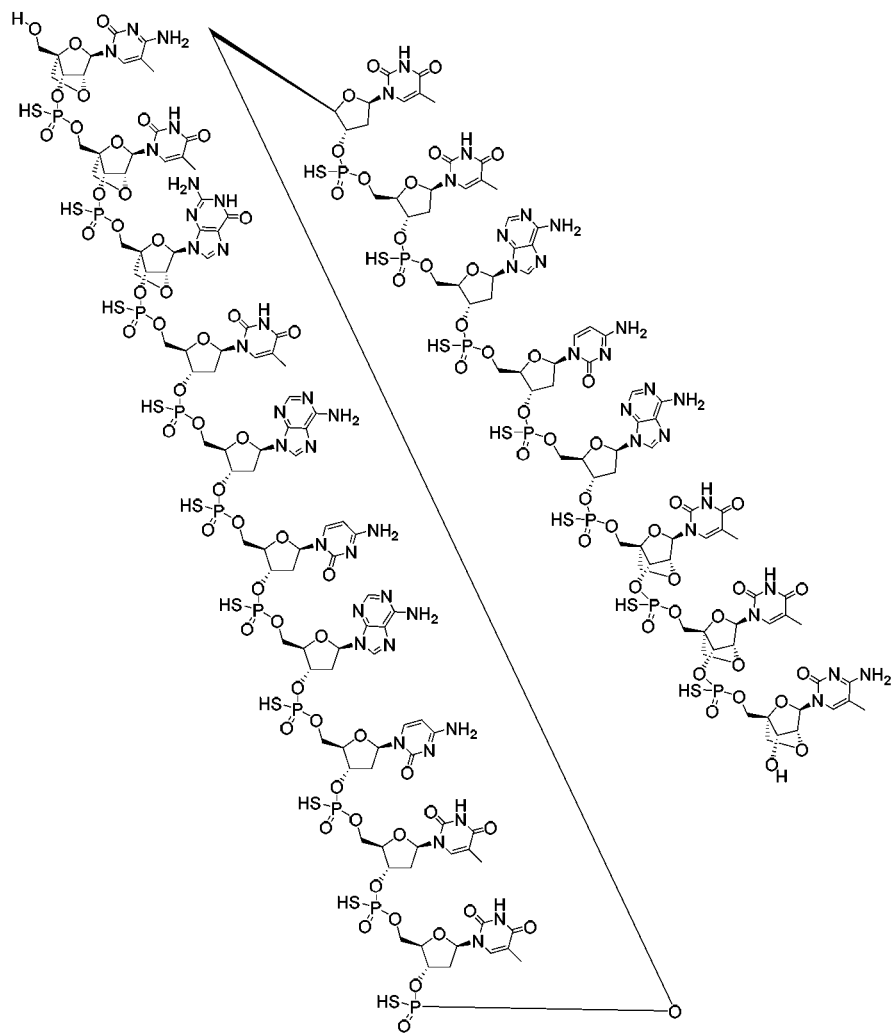

FIG. 2: Drawing of compound 1813_1 (SEQ ID NO 1813).

Figure 3:
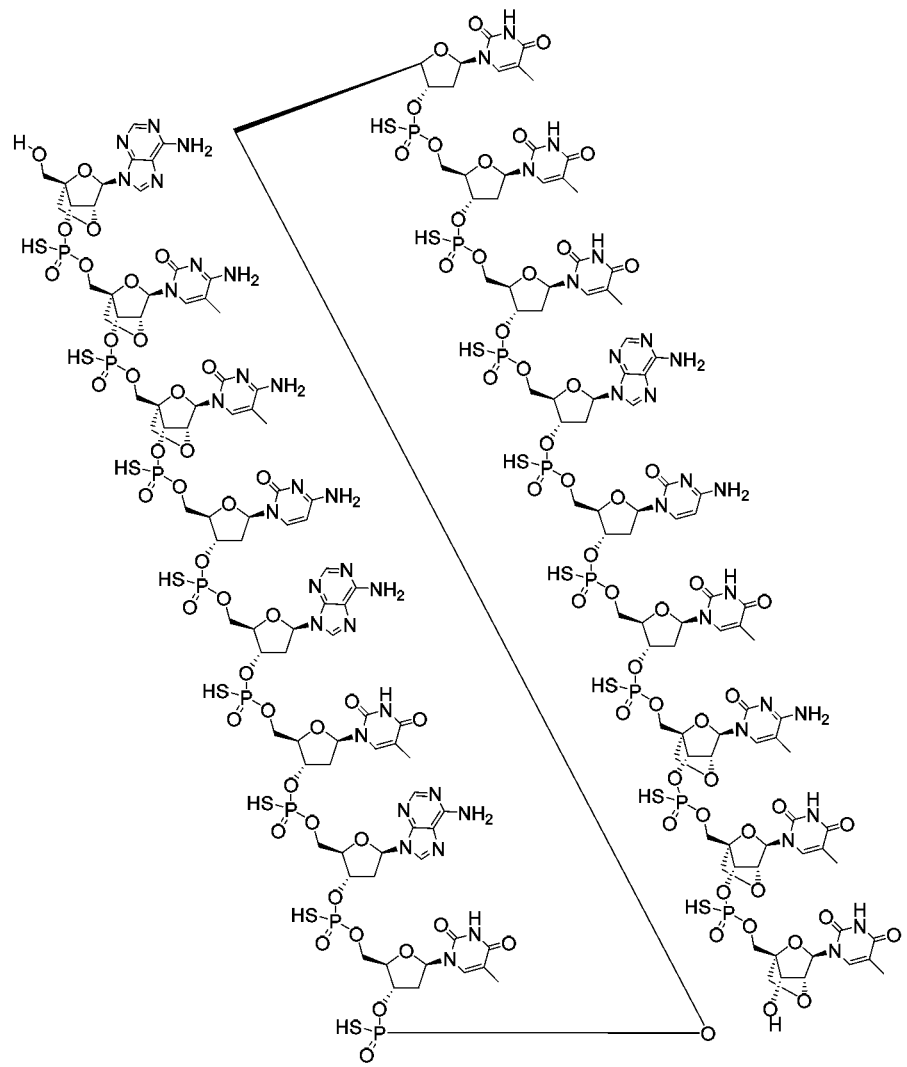

FIG. 3: Drawing of compound 1856_1 (SEQ ID NO 1856).

Figure 4:
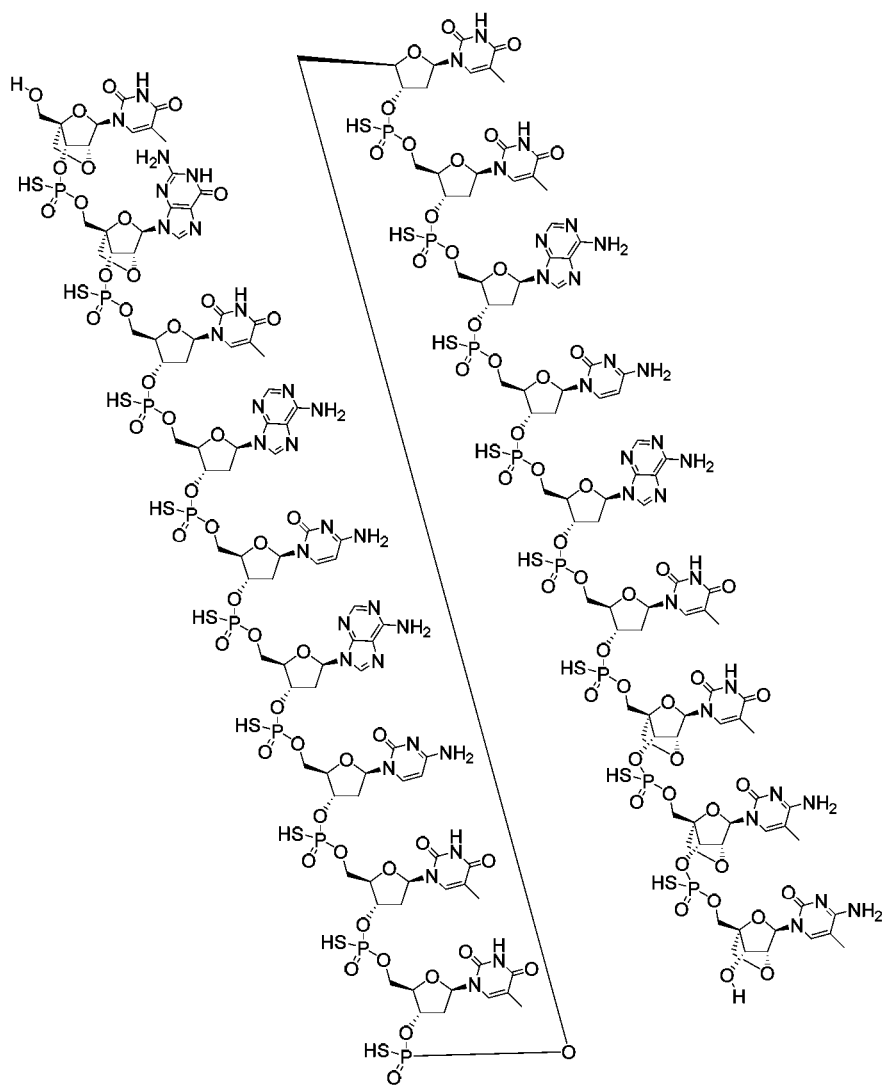

FIG. 4: Drawing of compound 1812_1 (SEQ ID NO 1812).

Figure 5:
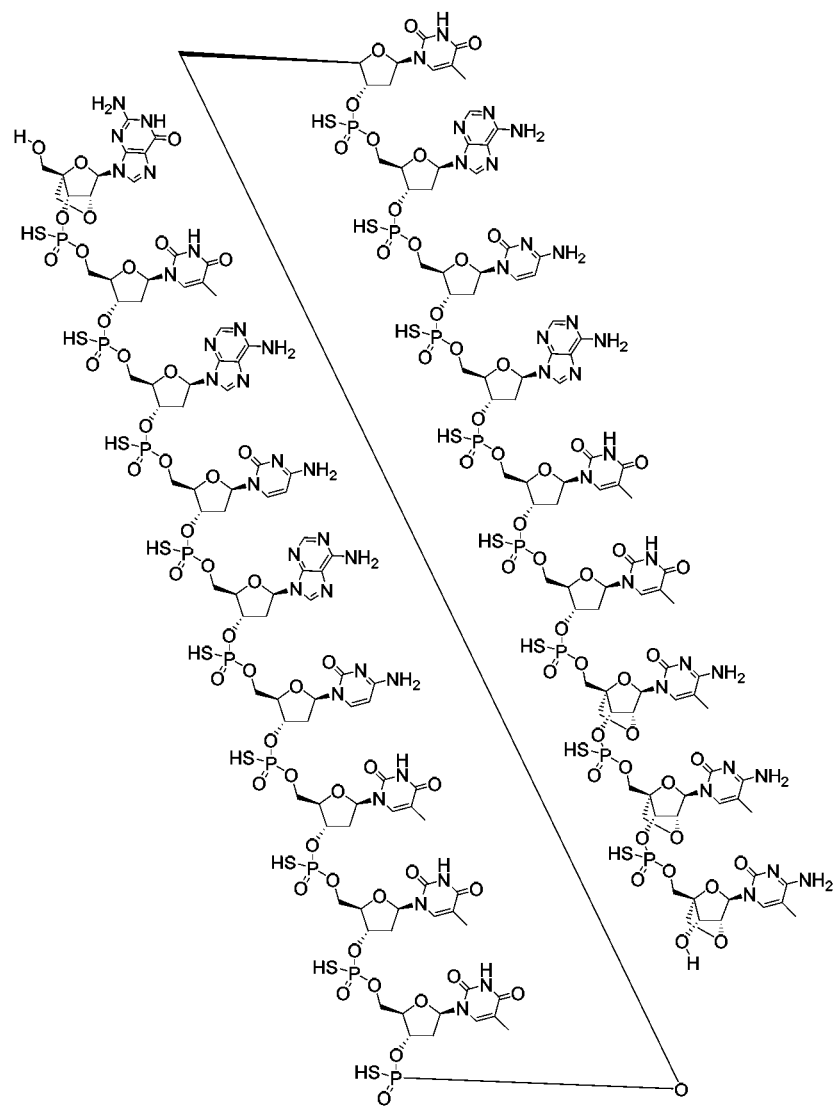

FIG. 5: Drawing of compound 1809_2 (SEQ ID NO 1809).

Figure 6:
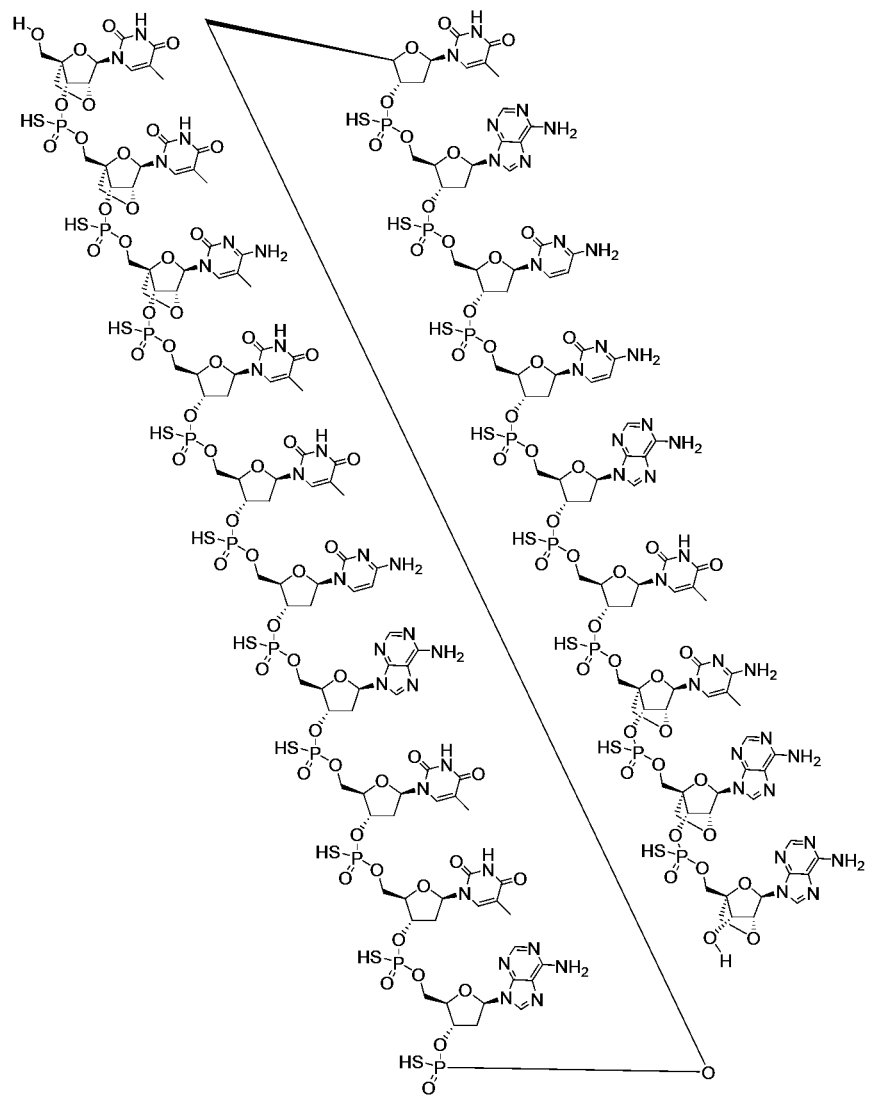

FIG. 6: Drawing of compound 1607_1 (SEQ ID NO 1607).

Figure 7:
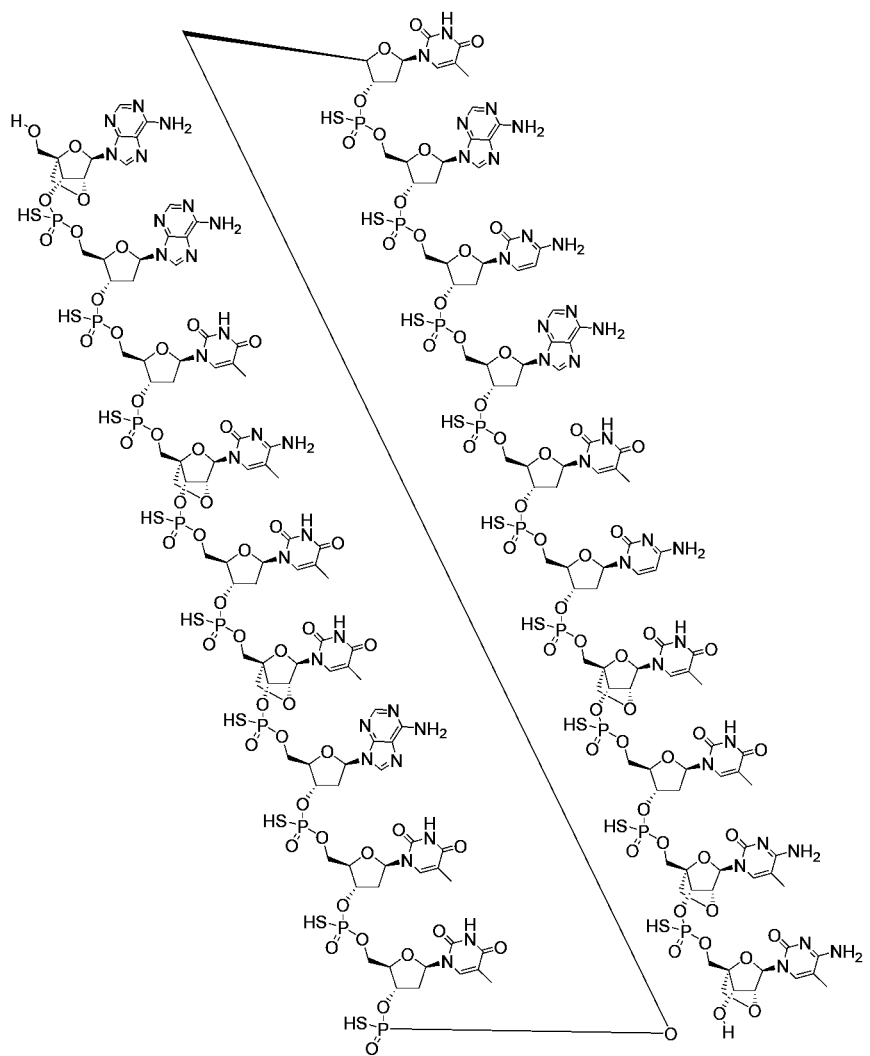

FIG. 7: Drawing of compound 1122_62 (SEQ ID NO 1122).

Figure 8:
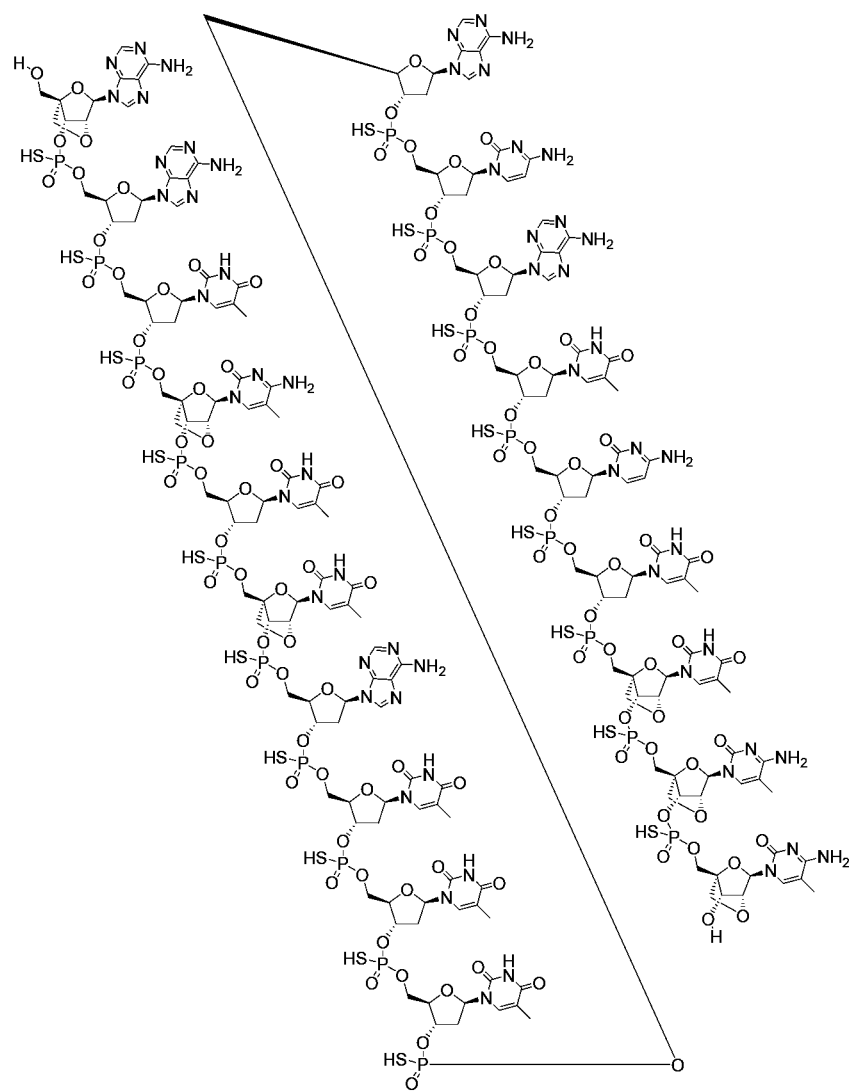

FIG. 8: Drawing of compound 1122_33 (SEQ ID NO 1122).

Figure 9:
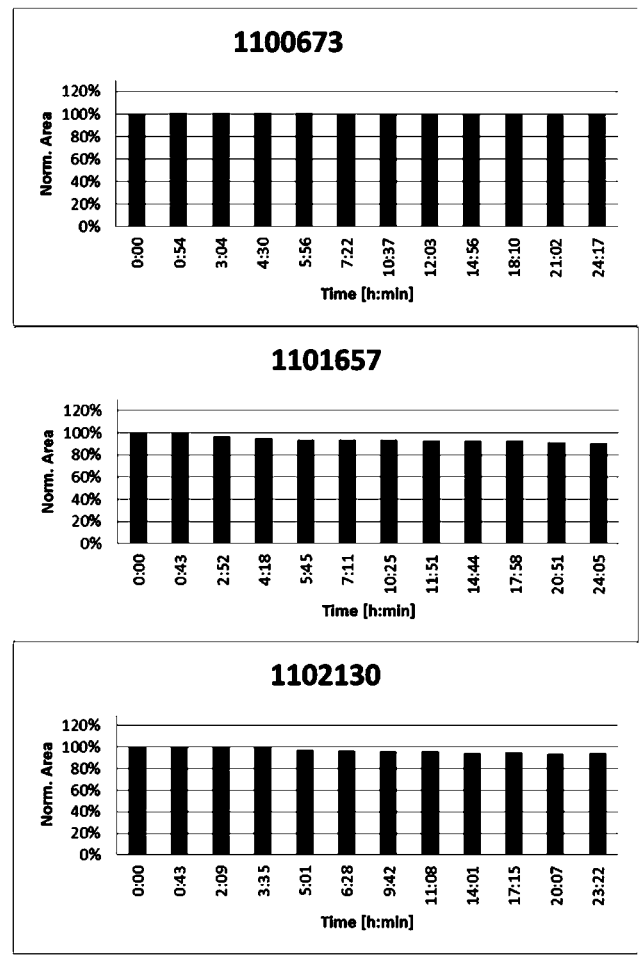
Figure 9:
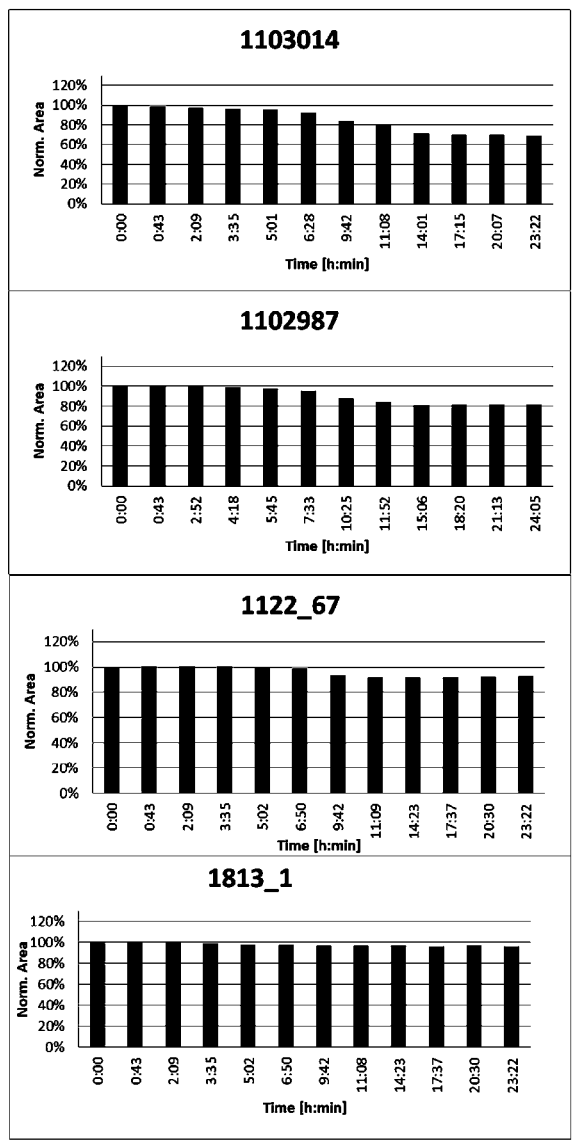

FIG. 9: Stability of compound 1122_67 and 1813_1, and 5 reference compounds in a 24 hour SVPD assay.

The chemical drawings are of the protonated form of the antisense oligonucleotide, and it will be understood that each hydrogen on the sulphur atom in the phosphorothioate internucleoside linkage may independently be present of absent. In a salt form, one or more more of the hydrogens may for example be replaced with a cation, such as a metal cation, such as a sodium cation or a potassium cation.

Definitions

Oligonucleotide

The term "oligonucleotide" as used herein is defined as it is generally understood by the skilled person as a molecule comprising two or more covalently linked nucleosides. Such covalently bound nucleosides may also be referred to as nucleic acid molecules or oligomers. Oligonucleotides are commonly made in the laboratory by solid-phase chemical synthesis followed by purification. When referring to a sequence of the oligonucleotide, reference is made to the sequence or order of nucleobase moieties, or modifications thereof, of the covalently linked nucleotides or nucleosides. The oligonucleotide of the invention is man-made, and is chemically synthesized, and is typically purified or isolated. The oligonucleotide of the invention may comprise one or more modified nucleosides or nucleotides.

Antisense Oligonucleotides

The term "Antisense oligonucleotide" as used herein is defined as oligonucleotides capable of modulating expression of a target gene by hybridizing to a target nucleic acid, in particular to a contiguous sequence on a target nucleic acid. The antisense oligonucleotides are not essentially double stranded and are therefore not siRNAs or shRNAs. Preferably, the antisense oligonucleotides of the present invention are single stranded. It is understood that single stranded oligonucleotides of the present invention can form hairpins or intermolecular duplex structures (duplex between two molecules of the same oligonucleotide), as long as the degree of intra or inter self-complementarity is less than 50% across of the full length of the oligonucleotide Contiguous Nucleotide Sequence The term "contiguous nucleotide sequence" refers to the region of the oligonucleotide which is complementary to the target nucleic acid. The term is used interchangeably herein with the term "contiguous nucleobase sequence" and the term "oligonucleotide motif sequence" also refered to as "motif sequence". The "motif sequence" may also be referred to as the "Oligonucleotide Base Sequence". In some embodiments all the nucleotides of the oligonucleotide constitute the contiguous nucleotide sequence. In some embodiments the oligonucleotide comprises the contiguous nucleotide sequence, such as a F-G-F' gapmer region, and may optionally comprise further nucleotide(s), for example a nucleotide linker region which may be used to attach a functional group to the contiguous nucleotide sequence. The nucleotide linker region may or may not be complementary to the target nucleic acid. Adventurously, the contiguous nucleotide sequence is 100% complementary to the target nucleic acid.

Nucleotides

Nucleotides are the building blocks of oligonucleotides and polynucleotides, and for the purposes of the present invention include both naturally occurring and non-naturally occurring nucleotides. In nature, nucleotides, such as DNA and RNA nucleotides comprise a ribose sugar moiety, a nucleobase moiety and one or more phosphate groups (which is absent in nucleosides). Nucleosides and nucleotides may also interchangeably be referred to as "units" or "monomers".

Modified Nucleoside

The term "modified nucleoside" or "nucleoside modification" as used herein refers to nucleosides modified as compared to the equivalent DNA or RNA nucleoside by the introduction of one or more modifications of the sugar moiety or the (nucleo)base moiety. In a preferred embodiment the modified nucleoside comprise a modified sugar moiety. The term modified nucleoside may also be used herein interchangeably with the term "nucleoside analogue" or modified "units" or modified "monomers". Nucleosides with an unmodified DNA or RNA sugar moiety are termed DNA or RNA nucleosides herein. Nucleosides with modifications in the base region of the DNA or RNA nucleoside are still generally termed DNA or RNA if they allow Watson Crick base pairing.

Modified Internucleoside Linkages

The term "modified internucleoside linkage" is defined as generally understood by the skilled person as linkages other than phosphodiester (PO) linkages, that covalently couples two nucleosides together. The oligonucleotides of the invention may therefore comprise modified internucleoside linkages. In some embodiments, the modified internucleoside linkage increases the nuclease resistance of the oligonucleotide compared to a phosphodiester linkage. For naturally occurring oligonucleotides, the internucleoside linkage includes phosphate groups creating a phosphodiester bond between adjacent nucleosides. Modified internucleoside linkages are particularly useful in stabilizing oligonucleotides for in vivo use, and may serve to protect against nuclease cleavage at regions of DNA or RNA nucleosides in the oligonucleotide of the invention, for example within the gap region of a gapmer oligonucleotide, as well as in regions of modified nucleosides, such as region F and F'. In an embodiment, the oligonucleotide comprises one or more internucleoside linkages modified from the natural phosphodiester, such one or more modified internucleoside linkages that is for example more resistant to nuclease attack. Nuclease resistance may be determined by incubating the oligonucleotide in blood serum or by using a nuclease resistance assay (e.g. snake venom phosphodiesterase (SVPD)), both are well known in the art. Internucleoside linkages which are capable of enhancing the nuclease resistance of an oligonucleotide are referred to as nuclease resistant internucleoside linkages. In some embodiments at least 50% of the internucleoside linkages in the oligonucleotide, or contiguous nucleotide sequence thereof, are modified, such as at least 60%, such as at least 70%, such as at least 80 or such as at least 90% of the internucleoside linkages in the oligonucleotide, or contiguous nucleotide sequence thereof, are nuclease resistant internucleoside linkages. In some embodiments all of the internucleoside linkages of the oligonucleotide, or contiguous nucleotide sequence thereof, are nuclease resistant internucleoside linkages. It will be recognized that, in some embodiments the nucleosides which link the oligonucleotide of the invention to a non-nucleotide functional group, such as a conjugate, may be phosphodiester.

A preferred modified internucleoside linkage is phosphorothioate.

Phosphorothioate internucleoside linkages are particularly useful due to nuclease resistance, beneficial pharmacokinetics and ease of manufacture. In some embodiments at least 50% of the internucleoside linkages in the oligonucleotide, or contiguous nucleotide sequence thereof, are phosphorothioate, such as at least 60%, such as at least 70%, such as at least 80% or such as at least 90% of the internucleoside linkages in the oligonucleotide, or contiguous nucleotide sequence thereof, are phosphorothioate. In some embodiments all of the internucleoside linkages of the oligonucleotide, or contiguous nucleotide sequence thereof, are phosphorothioate.

Nuclease resistant linkages, such as phosphorothioate linkages, are particularly useful in oligonucleotide regions capable of recruiting nuclease when forming a duplex with the target nucleic acid, such as region G for gapmers. Phosphorothioate linkages may, however, also be useful in non-nuclease recruiting regions and/or affinity enhancing regions such as regions F and F' for gapmers. Gapmer oligonucleotides may, in some embodiments comprise one or more phosphodiester linkages in region F or F', or both region F and F', which the internucleoside linkage in region G may be fully phosphorothioate. Advantageously, all the internucleoside linkages in the contiguous nucleotide sequence of the oligonucleotide are phosphorothioate linkages.

It is recognized that, as disclosed in EP2 742 135, antisense oligonucleotide may comprise other internucleoside linkages (other than phosphodiester and phosphorothioate), for example alkyl phosphonate/methyl phosphonate internucleosides, which according to EP2 742 135 may for example be tolerated in an otherwise DNA phosphorothioate gap region.

Nucleobase

The term nucleobase includes the purine (e.g. adenine and guanine) and pyrimidine (e.g. uracil, thymine and cytosine) moiety present in nucleosides and nucleotides which form hydrogen bonds in nucleic acid hybridization. In the context of the present invention the term nucleobase also encompasses modified nucleobases which may differ from naturally occurring nucleobases, but are functional during nucleic acid hybridization. In this context "nucleobase" refers to both naturally occurring nucleobases such as adenine, guanine, cytosine, thymidine, uracil, xanthine and hypoxanthine, as well as non-naturally occurring variants. Such variants are for example described in Hirao et al (2012) Accounts of Chemical Research vol 45 page 2055 and Bergstrom (2009) Current Protocols in Nucleic Acid Chemistry Suppl. 37 1.4.1.

In a some embodiments the nucleobase moiety is modified by changing the purine or pyrimidine into a modified purine or pyrimidine, such as substituted purine or substituted pyrimidine, such as a nucleobased selected from isocytosine, pseudoisocytosine, 5-methyl cytosine, 5-thiozolo-cytosine, 5-propynyl-cytosine, 5-propynyl-uracil, 5-bromouracil 5-thiazolo-uracil, 2-thio-uracil, 2'thio-thymine, inosine, diaminopurine, 6-aminopurine, 2-aminopurine, 2,6-diaminopurine and 2-chloro-6-aminopurine.

The nucleobase moieties may be indicated by the letter code for each corresponding nucleobase, e.g. A, T, G, C or U, wherein each letter may optionally include modified nucleobases of equivalent function. For example, in the exemplified oligonucleotides, the nucleobase moieties are selected from A, T, G, C, and 5-methyl cytosine. Optionally, for LNA gapmers, 5-methyl cytosine LNA nucleosides may be used.

Modified Oligonucleotide

The term modified oligonucleotide describes an oligonucleotide comprising one or more sugar-modified nucleosides and/or modified internucleoside linkages. The term chimeric" oligonucleotide is a term that has been used in the literature to describe oligonucleotides with modified nucleosides.

Complementarity

The term "complementarity" describes the capacity for Watson-Crick base-pairing of nucleosides/nucleotides. Watson-Crick base pairs are guanine (G)-cytosine (C) and adenine (A)—thymine (T)/uracil (U). It will be understood that oligonucleotides may comprise nucleosides with modified nucleobases, for example 5-methyl cytosine is often used in place of cytosine, and as such the term complementarity encompasses Watson Crick base-paring between non-modified and modified nucleobases (see for example Hirao et al (2012) Accounts of Chemical Research vol 45 page 2055 and Bergstrom (2009) Current Protocols in Nucleic Acid Chemistry Suppl. 37 1.4.1).

The term "% complementary" as used herein, refers to the number of nucleotides in percent of a contiguous nucleotide sequence in a nucleic acid molecule (e.g. oligonucleotide) which, at a given position, are complementary to (i.e. form Watson Crick base pairs with) a contiguous sequence of nucleotides, at a given position of a separate nucleic acid molecule (e.g. the target nucleic acid or target sequence). The percentage is calculated by counting the number of aligned bases that form pairs between the two sequences (when aligned with the target sequence 5'-3' and the oligonucleotide sequence from 3'-5'), dividing by the total number of nucleotides in the oligonucleotide and multiplying by 100. In such a comparison a nucleobase/nucleotide which does not align (form a base pair) is termed a mismatch. Preferably, insertions and deletions are not allowed in the calculation of % complementarity of a contiguous nucleotide sequence.

The term "fully complementary", refers to 100% complementarity.

Identity

The term "Identity" as used herein, refers to the proportion of nucleotides (expressed in percent) of a contiguous nucleotide sequence in a nucleic acid molecule (e.g. oligonucleotide) which across the contiguous nucleotide sequence, are identical to a reference sequence (e.g. a sequence motif). The percentage of identity is thus calculated by counting the number of aligned bases that are identical (a match) between two sequences (e.g. in the contiguous nucleotide sequence of the compound of the invention and in the reference sequence), dividing that number by the total number of nucleotides in the aligned region and multiplying by 100. Therefore, Percentage of Identity=(Matches×100)/Length of aligned region (e.g. the contiguous nucleotide sequence). Insertions and deletions are not allowed in the calculation the percentage of identity of a contiguous nucleotide sequence. It will be understood that in determining identity, chemical modifications of the nucleobases are disregarded as long as the functional capacity of the nucleobase to form Watson Crick base pairing is retained (e.g. 5-methyl cytosine is considered identical to a cytosine for the purpose of calculating % identity).

Hybridization

The term "hybridizing" or "hybridizes" as used herein is to be understood as two nucleic acid strands (e.g. an oligonucleotide and a target nucleic acid) forming hydrogen bonds between base pairs on opposite strands thereby forming a duplex. The affinity of the binding between two nucleic acid strands is the strength of the hybridization. It is often described in terms of the melting temperature ($T_m$) defined as the temperature at which half of the oligonucleotides are duplexed with the target nucleic acid. At physiological conditions $T_m$ is not strictly proportional to the affinity (Mergny and Lacroix, 2003, *Oligonucleotides* 13:515-537). The standard state Gibbs free energy $\Delta G°$ is a more accurate representation of binding affinity and is related to the dissociation constant ($K_d$) of the reaction by $\Delta G°=-RT\ln(K_d)$, where R is the gas constant and T is the absolute temperature. Therefore, a very low $\Delta G°$ of the reaction between an oligonucleotide and the target nucleic acid reflects a strong hybridization between the oligonucleotide and target nucleic acid. $\Delta G°$ is the energy associated with a reaction where aqueous concentrations are 1M, the pH is 7, and the temperature is 37° C. The hybridization of oligonucleotides to a target nucleic acid is a spontaneous reaction and for spontaneous reactions $\Delta G°$ is less than zero. $\Delta G°$ can be measured experimentally, for example, by use of the isothermal titration calorimetry (ITC) method as described in Hansen et al., 1965, *Chem. Comm.* 36-38 and Holdgate et al., 2005, *Drug Discov Today*. The skilled person will know that commercial equipment is available for $\Delta G°$ measurements. $\Delta G°$ can also be estimated numerically by using the nearest neighbor model as described by SantaLucia, 1998, *Proc Natl Acad Sci USA*. 95: 1460-1465 using appropriately derived thermodynamic parameters described by Sugimoto et al., 1995, *Biochemistry* 34:11211-11216 and McTigue et al., 2004, Biochemistry 43:5388-5405. In order to have the possibility of modulating its intended nucleic acid target by hybridization, oligonucleotides of the present invention hybridize to a target nucleic acid with estimated ΔG° values below −10 kcal for oligonucleotides that are 10-30 nucleotides in length. In some embodiments the degree or strength of hybridization is measured by the standard state Gibbs free energy ΔG°. The oligonucleotides may hybridize to a target nucleic acid with estimated ΔG° values below the range of −10 kcal, such as below −15 kcal, such as below −20 kcal and such as below −25 kcal for oligonucleotides that are 8-30 nucleotides in length. In some embodiments the oligonucleotides hybridize to a target nucleic acid with an estimated ΔG° value of −10 to −60 kcal, such as −12 to −40, such as from −15 to −30 kcal or −16 to −27 kcal such as −18 to −25 kcal.

Target Nucleic Acid

According to the present invention, the target nucleic acid is a nucleic acid which encodes a mammalian ATXN3 protein and may for example be a gene, a ATXN3 RNA, a mRNA, a pre-mRNA, a mature mRNA or a cDNA sequence. The target may therefore be referred to as an ATXN3 target nucleic acid.

In some embodiments, the target nucleic acid encodes a human ATXN3 protein, such as the human ATXN3 gene encoding the pre-mRNA sequence provided herein as SEQ ID NO 1. Thus, the target nucleic acid may be SEQ ID NO 1.

In some embodiments, the target nucleic acid encodes a mouse ATXN3 protein. Suitably, the target nucleic acid encoding a mouse ATXN3 protein comprises a sequence as shown in SEQ ID NO: 3.

In some embodiments, the target nucleic acid encodes a cynomolgus monkey ATXN3 protein. Suitably, the target nucleic acid encoding a cynomolgus monkey ATXN3 protein comprises a sequence as shown in SEQ ID NO: 2.

If employing the oligonucleotide of the invention in research or diagnostics the target nucleic acid may be a cDNA or a synthetic nucleic acid derived from DNA or RNA.

For in vivo or in vitro application, the oligonucleotide of the invention is typically capable of inhibiting the expression of the ATXN3 target nucleic acid in a cell which is expressing the ATXN3 target nucleic acid. The contiguous sequence of nucleobases of the oligonucleotide of the invention is typically complementary to the ATXN3 target nucleic acid, as measured across the length of the oligonucleotide, optionally with the exception of one or two mismatches, and optionally excluding nucleotide based linker regions which may link the oligonucleotide to an optional functional group such as a conjugate, or other non-complementary terminal nucleotides (e.g. region D' or D"). The target nucleic acid is a messenger RNA, such as a mature mRNA or a pre-mRNA which encodes mammalian ATXN3 protein, such as human ATXN3, e.g. the human ATXN3 pre-mRNA sequence, such as that disclosed as SEQ ID NO 1, or ATXN3 mature mRNA. Further, the target nucleic acid may be a cynomolgus monkey ATXN3 pre-mRNA sequence, such as that disclosed as SEQ ID NO 1, or a cynomolgus monkey ATXN3 mature mRNA. Further, the target nucleic acid may be a mouse ATXN3 pre-mRNA sequence, such as that disclosed as SEQ ID NO 3, or mouse ATXN3 mature mRNA. SEQ ID NOs 1-3 are DNA sequences—it will be understood that target RNA sequences have uracil (U) bases in place of the thymidine bases (T).

TABLE 1

| Target Nucleic Acid | Sequence ID |
|---|---|
| ATXN3 Homo sapiens pre-mRNA | SEQ ID NO 1 |
| ATXN3 Macaca fascicularis pre-mRNA | SEQ ID NO 2 |
| ATXN3 Mus musculus mRNA | SEQ ID NO 3 |

In some embodiments, the oligonucleotide of the invention targets SEQ ID NO 1.

In some embodiments, the oligonucleotide of the invention targets SEQ ID NO 2.

In some embodiments, the oligonucleotide of the invention targets SEQ ID NO 3.

In some embodiments, the oligonucleotide of the invention targets SEQ ID NO 1 and SEQ ID NO 2.

In some embodiments, the oligonucleotide of the invention targets SEQ ID NO 1 and SEQ ID NO 3.

In some embodiments, the oligonucleotide of the invention targets SEQ ID NO 1, SEQ ID NO 2 and SEQ ID NO 3.

Target Sequence

The term "target sequence" as used herein refers to a sequence of nucleotides present in the target nucleic acid which comprises the nucleobase sequence which is complementary to the oligonucleotide of the invention. In some embodiments, the target sequence consists of a region on the target nucleic acid which is complementary to the contiguous nucleotide sequence of the oligonucleotide of the invention.

Herein are provided numerous target sequence regions, as defined by regions of the human ATXN3 pre-mRNA (using SEQ ID NO 1 as a reference) which may be targeted by the oligonucleotides of the invention.

In some embodiments the target sequence is longer than the complementary sequence of a single oligonucleotide, and may, for example represent a preferred region of the target nucleic acid which may be targeted by several oligonucleotides of the invention.

The oligonucleotide of the invention comprises a contiguous nucleotide sequence which is complementary to or hybridizes to the target nucleic acid, such as a sub-sequence of the target nucleic acid, such as a target sequence described herein.

The oligonucleotide comprises a contiguous nucleotide sequence which are complementary to a target sequence present in the target nucleic acid molecule. The contiguous nucleotide sequence (and therefore the target sequence) comprises of at least 10 contiguous nucleotides, such as 9, 10, 11, 12, 13, 14, 15, 16, 17, 18, 19, 20, 21, 22, 23, 24, 25, 26, 27, 28, 29 or 30 contiguous nucleotides, such as from 12-25, such as from 14-18 contiguous nucleotides.

Target Sequence Regions

In an aspect, the invention provides for an antisense oligonucleotide, 10-30 nucleotides in length, wherein said antisense oligonucleotide comprises a contiguous nucleotide sequence 10-30 nucleotides in length, wherein the contiguous nucleotide sequence is at least 90% complementary, to a region of SEQ ID NO 1. The region of SEQ ID NO 1 to which the antisense oligonucleotide of the invention is complementary to is referred to as the target sequence region.

In some embodiments the target sequence region is AAGAGTAAAATATGGGT (SEQ ID NO 1093).

In some embodiments the target sequence region is GAATGTAAAAGTGTACAG (SEQ ID NO 1094).

In some embodiments the target sequence region is GGAATGTAAAAGTGTACA (SEQ ID NO 1095).

In some embodiments the target sequence region is GGGAATGTAAAAGTGTAC (SEQ ID NO 1096).

In some embodiments the target sequence region is TTGATGGTATAATGAAGAA (SEQ ID NO 1097).

In some embodiments the target sequence region is GGAAGATGTAAATAAGATT (SEQ ID NO 1098).

Target Cell

The term a "target cell" as used herein refers to a cell which is expressing the target nucleic acid. In some embodiments the target cell may be in vivo or in vitro. In some embodiments the target cell is a mammalian cell such as a rodent cell, such as a mouse cell or a rat cell, or a primate cell such as a monkey cell (e.g. a cynomolgus monkey cell) or a human cell. In preferred embodiments the target cell expresses human ATXN3 mRNA, such as the ATXN3 pre-mRNA, e.g. SEQ ID NO 1, or ATXN3 mature mRNA. In some embodiments the target cell expresses monkey ATXN3 mRNA, such as the ATXN3 pre-mRNA, e.g. SEQ ID NO 2, or ATXN3 mature mRNA. In some embodiments the target cell expresses mouse ATXN3 mRNA, such as the ATXN3 pre-mRNA, e.g. SEQ ID NO 3, or ATXN3 mature mRNA. The poly A tail of ATXN3 mRNA is typically disregarded for antisense oligonucleotide targeting.

Naturally Occurring Variant

The term "naturally occurring variant" refers to variants of ATXN3 gene or transcripts which originate from the same genetic loci as the target nucleic acid, but may differ for example, by virtue of degeneracy of the genetic code causing a multiplicity of codons encoding the same amino acid, or due to alternative splicing of pre-mRNA, or the presence of polymorphisms, such as single nucleotide polymorphisms (SNPs), and allelic variants. Based on the presence of the sufficient complementary sequence to the oligonucleotide, the oligonucleotide of the invention may therefore target the target nucleic acid and naturally occurring variants thereof.

The *Homo sapiens* ATXN3 gene is located at chromosome 14, 92058552 . . . 92106621, complement (NC_000014.9, Gene ID 4287).

In some embodiments, the naturally occurring variants have at least 95% such as at least 98% or at least 99% homology to a mammalian ATXN3 target nucleic acid, such as a target nucleic acid selected form the group consisting of SEQ ID NO 1, 2 and 3. In some embodiments the naturally occurring variants have at least 99% homology to the human ATXN3 target nucleic acid of SEQ ID NO 1.

Modulation of Expression

The term "modulation of expression" as used herein is to be understood as an overall term for an oligonucleotide's ability to alter the amount of ATXN3 protein or ATXN3 mRNA when compared to the amount of ATXN3 or ATXN3 mRNA prior to administration of the oligonucleotide. Alternatively modulation of expression may be determined by reference to a control experiment. It is generally understood that the control is an individual or target cell treated with a saline composition or an individual or target cell treated with a non-targeting oligonucleotide (mock).

One type of modulation is an oligonucleotide's ability to inhibit, down-regulate, reduce, suppress, remove, stop, block, prevent, lessen, lower, avoid or terminate expression of ATXN3, e.g. by degradation of ATXN3 mRNA.

High Affinity Modified Nucleosides

A high affinity modified nucleoside is a modified nucleotide which, when incorporated into the oligonucleotide enhances the affinity of the oligonucleotide for its complementary target, for example as measured by the melting temperature ($T^m$). A high affinity modified nucleoside of the present invention preferably result in an increase in melting temperature between +0.5 to +12° C., more preferably between +1.5 to +10° C. and most preferably between +3 to +8° C. per modified nucleoside. Numerous high affinity modified nucleosides are known in the art and include for example, many 2' substituted nucleosides as well as locked nucleic acids (LNA) (see e.g. Freier & Altmann; Nucl. Acid Res., 1997, 25, 4429-4443 and Uhlmann; Curr. Opinion in Drug Development, 2000, 3(2), 293-213).

Sugar Modifications

The oligomer of the invention may comprise one or more nucleosides which have a modified sugar moiety, i.e. a modification of the sugar moiety when compared to the ribose sugar moiety found in DNA and RNA.

Numerous nucleosides with modification of the ribose sugar moiety have been made, primarily with the aim of improving certain properties of oligonucleotides, such as affinity and/or nuclease resistance.

Such modifications include those where the ribose ring structure is modified, e.g. by replacement with a hexose ring (HNA), or a bicyclic ring, which typically have a biradicle bridge between the C2 and C4 carbons on the ribose ring (LNA), or an unlinked ribose ring which typically lacks a bond between the C2 and C3 carbons (e.g. UNA). Other sugar modified nucleosides include, for example, bicyclohexose nucleic acids (WO2011/017521) or tricyclic nucleic acids (WO2013/154798). Modified nucleosides also include nucleosides where the sugar moiety is replaced with a non-sugar moiety, for example in the case of peptide nucleic acids (PNA), or morpholino nucleic acids.

Sugar modifications also include modifications made via altering the substituent groups on the ribose ring to groups other than hydrogen, or the 2'—OH group naturally found in DNA and RNA nucleosides. Substituents may, for example be introduced at the 2', 3', 4' or 5' positions.

2' Sugar Modified Nucleosides.

A 2' sugar modified nucleoside is a nucleoside which has a substituent other than H or —OH at the 2' position (2' substituted nucleoside) or comprises a 2' linked biradicle capable of forming a bridge between the 2' carbon and a second carbon in the ribose ring, such as LNA (2'-4' biradicle bridged) nucleosides.

Indeed, much focus has been spent on developing 2' substituted nucleosides, and numerous 2' substituted nucleosides have been found to have beneficial properties when incorporated into oligonucleotides. For example, the 2' modified sugar may provide enhanced binding affinity and/or increased nuclease resistance to the oligonucleotide. Examples of 2' substituted modified nucleosides are 2'-O-alkyl-RNA, 2'-O-methyl-RNA, 2'-alkoxy-RNA, 2'-O-methoxyethyl-RNA (MOE), 2'-amino-DNA, 2'-Fluoro-RNA, and 2'-F-ANA nucleoside. For further examples, please see e.g. Freier & Altmann; Nucl. Acid Res., 1997, 25, 4429-4443 and Uhlmann; Curr. Opinion in Drug Development, 2000, 3(2), 293-213, and Deleavey and Damha, Chemistry and Biology 2012, 19, 937. Below are illustrations of some 2' substituted modified nucleosides.

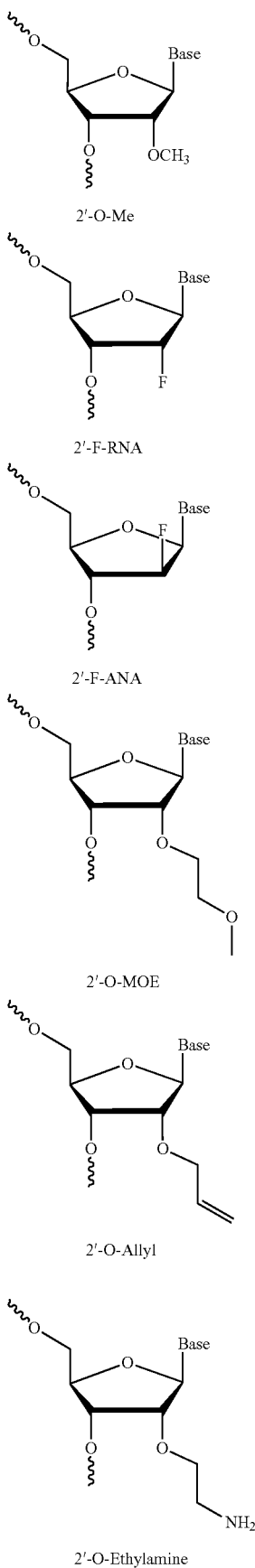

In relation to the present invention 2' substituted does not include 2' bridged molecules like LNA.

Locked Nucleic Acids (LNA)

A "LNA nucleoside" is a 2'-modified nucleoside which comprises a biradical linking the C2' and C4' of the ribose sugar ring of said nucleoside (also referred to as a "2'-4' bridge"), which restricts or locks the conformation of the ribose ring. These nucleosides are also termed bridged nucleic acid or bicyclic nucleic acid (BNA) in the literature. The locking of the conformation of the ribose is associated with an enhanced affinity of hybridization (duplex stabilization) when the LNA is incorporated into an oligonucleotide for a complementary RNA or DNA molecule. This can be routinely determined by measuring the melting temperature of the oligonucleotide/complement duplex.

Non limiting, exemplary LNA nucleosides are disclosed in WO 99/014226, WO 00/66604, WO 98/039352, WO 2004/046160, WO 00/047599, WO 2007/134181, WO 2010/077578, WO 2010/036698, WO 2007/090071, WO 2009/006478, WO 2011/156202, WO 2008/154401, WO 2009/067647, WO 2008/150729, Morita et al., Bioorganic & Med. Chem. Lett. 12, 73-76, Seth et al. J. Org. Chem. 2010, Vol 75(5) pp. 1569-81, and Mitsuoka et al., Nucleic Acids Research 2009, 37(4), 1225-1238, and Wan and Seth, J. Medical Chemistry 2016, 59, 9645-9667.

Further non limiting, exemplary LNA nucleosides are disclosed in Scheme 1.

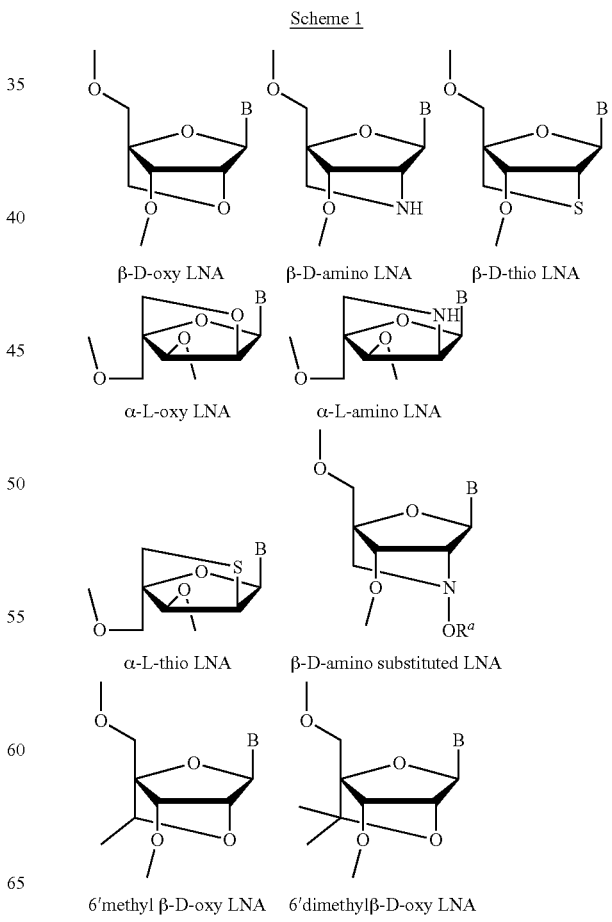

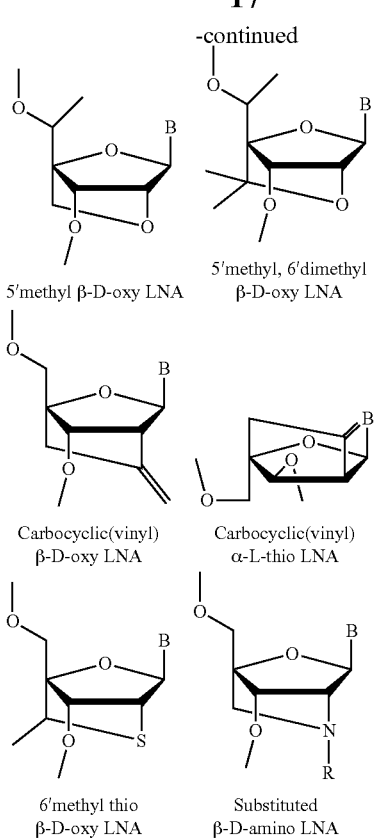

5′methyl β-D-oxy LNA

5′methyl, 6′dimethyl β-D-oxy LNA

Carbocyclic(vinyl) β-D-oxy LNA

Carbocyclic(vinyl) α-L-thio LNA

6′methyl thio β-D-oxy LNA

Substituted β-D-amino LNA

Particular LNA nucleosides are beta-D-oxy-LNA, 6′-methyl-beta-D-oxy LNA such as (S)-6′-methyl-beta-D-oxy-LNA (ScET) and ENA.

A particularly advantageous LNA is beta-D-oxy-LNA.

RNase H Activity and Recruitment

The RNase H activity of an antisense oligonucleotide refers to its ability to recruit RNase H when in a duplex with a complementary RNA molecule. WO01/23613 provides in vitro methods for determining RNaseH activity, which may be used to determine the ability to recruit RNaseH. Typically an oligonucleotide is deemed capable of recruiting RNase H if it, when provided with a complementary target nucleic acid sequence, has an initial rate, as measured in pmol/l/min, of at least 5%, such as at least 10% or more than 20% of the of the initial rate determined when using a oligonucleotide having the same base sequence as the modified oligonucleotide being tested, but containing only DNA monomers with phosphorothioate linkages between all monomers in the oligonucleotide, and using the methodology provided by Example 91-95 of WO01/23613 (hereby incorporated by reference). For use in determining RHase H activity, recombinant human RNase H1 is available from Lubio Science GmbH, Lucerne, Switzerland.

Gapmer

The antisense oligonucleotide of the invention, or contiguous nucleotide sequence thereof may be a gapmer. The antisense gapmers are commonly used to inhibit a target nucleic acid via RNase H mediated degradation. A gapmer oligonucleotide comprises at least three distinct structural regions a 5′-flank, a gap and a 3′-flank, F-G-F′ in the '5→3' orientation. The "gap" region (G) comprises a stretch of contiguous DNA nucleotides which enable the oligonucleotide to recruit RNase H. The gap region is flanked by a 5′ flanking region (F) comprising one or more sugar modified nucleosides, advantageously high affinity sugar modified nucleosides, and by a 3′ flanking region (F′) comprising one or more sugar modified nucleosides, advantageously high affinity sugar modified nucleosides. The one or more sugar modified nucleosides in region F and F′ enhance the affinity of the oligonucleotide for the target nucleic acid (i.e. are affinity enhancing sugar modified nucleosides). In some embodiments, the one or more sugar modified nucleosides in region F and F′ are 2′ sugar modified nucleosides, such as high affinity 2′ sugar modifications, such as independently selected from LNA and 2′-MOE.

In a gapmer design, the 5′ and 3′ most nucleosides of the gap region are DNA nucleosides, and are positioned adjacent to a sugar modified nucleoside of the 5′ (F) or 3′ (F′) region respectively. The flanks may further defined by having at least one sugar modified nucleoside at the end most distant from the gap region, i.e. at the 5′ end of the 5′ flank and at the 3′ end of the 3′ flank.

Regions F-G-F′ form a contiguous nucleotide sequence. Antisense oligonucleotides of the invention, or the contiguous nucleotide sequence thereof, may comprise a gapmer region of formula F-G-F′.

The overall length of the gapmer design F-G-F′ may be, for example 12 to 32 nucleosides, such as 13 to 24, such as 14 to 22 nucleosides, Such as from 14 to 17, such as 16 to 18 nucleosides.

By way of example, the gapmer oligonucleotide of the present invention can be represented by the following formulae:

$F_{1-8}\text{-}G_{5-16}\text{-}F'_{1-8}$, such as $F_{1-8}\text{-}G_{7-16}\text{-}F'_{2-8}$ with the proviso that the overall length of the gapmer regions F-G-F′ is at least 12, such as at least 14 nucleotides in length.

Regions F, G and F′ are further defined below and can be incorporated into the F-G-F′ formula.

Gapmer—Region G

Region G (gap region) of the gapmer is a region of nucleosides which enables the oligonucleotide to recruit RNaseH, such as human RNase H1, typically DNA nucleosides. RNaseH is a cellular enzyme which recognizes the duplex between DNA and RNA, and enzymatically cleaves the RNA molecule. Suitably gapmers may have a gap region (G) of at least 5 or 6 contiguous DNA nucleosides, such as 5-16 contiguous DNA nucleosides, such as 6-15 contiguous DNA nucleosides, such as 7-14 contiguous DNA nucleosides, such as 8-12 contiguous DNA nucleotides, such as 8-12 contiguous DNA nucleotides in length. The gap region G may, in some embodiments consist of 6, 7, 8, 9, 10, 11, 12, 13, 14, 15 or 16 contiguous DNA nucleosides. One or more cytosine (C) DNA in the gap region may in some instances be methylated (e.g. when a DNA c is followed by a DNA g) such residues are either annotated as 5-methyl-cytosine ($^{me}C$). In some embodiments the gap region G may consist of 6, 7, 8, 9, 10, 11, 12, 13, 14, 15 or 16 contiguous phosphorothioate linked DNA nucleosides. In some embodiments, all internucleoside linkages in the gap are phosphorothioate linkages.

Whilst traditional gapmers have a DNA gap region, there are numerous examples of modified nucleosides which allow for RNaseH recruitment when they are used within the gap region. Modified nucleosides which have been reported as being capable of recruiting RNaseH when included within a gap region include, for example, alpha-L-LNA, C4′ alkylated DNA (as described in PCT/EP2009/050349 and Vester et al., Bioorg. Med. Chem. Lett. 18 (2008) 2296-2300, both incorporated herein by reference), arabinose derived nucleosides like ANA and 2'F-ANA (Mangos et al. 2003 J. AM. CHEM. SOC. 125, 654-661), UNA (unlocked nucleic acid) (as described in Fluiter et al., Mol. Biosyst., 2009, 10, 1039 incorporated herein by reference). UNA is unlocked nucleic acid, typically where the bond between C2 and C3 of the ribose has been removed, forming an unlocked "sugar" residue. The modified nucleosides used in such gapmers may be nucleosides which adopt a 2' endo (DNA like) structure when introduced into the gap region, i.e. modifications which allow for RNaseH recruitment). In some embodiments the DNA Gap region (G) described herein may optionally contain 1 to 3 sugar modified nucleosides which adopt a 2' endo (DNA like) structure when introduced into the gap region.

Region G—"Gap-Breaker"

Alternatively, there are numerous reports of the insertion of a modified nucleoside which confers a 3' endo conformation into the gap region of gapmers, whilst retaining some RNaseH activity. Such gapmers with a gap region comprising one or more 3'endo modified nucleosides are referred to as "gap-breaker" or "gap-disrupted" gapmers, see for example WO2013/022984. Gap-breaker oligonucleotides retain sufficient region of DNA nucleosides within the gap region to allow for RNaseH recruitment. The ability of gapbreaker oligonucleotide design to recruit RNaseH is typically sequence or even compound specific—see Rukov et al. 2015 Nucl. Acids Res. Vol. 43 pp. 8476-8487, which discloses "gapbreaker" oligonucleotides which recruit RNaseH which in some instances provide a more specific cleavage of the target RNA. Modified nucleosides used within the gap region of gap-breaker oligonucleotides may for example be modified nucleosides which confer a 3'endo confirmation, such 2'-O-methyl (OMe) or 2'-O-MOE (MOE) nucleosides, or beta-D LNA nucleosides (the bridge between C2' and C4' of the ribose sugar ring of a nucleoside is in the beta conformation), such as beta-D-oxy LNA or ScET nucleosides.

As with gapmers containing region G described above, the gap region of gap-breaker or gap-disrupted gapmers, have a DNA nucleosides at the 5' end of the gap (adjacent to the 3' nucleoside of region F), and a DNA nucleoside at the 3' end of the gap (adjacent to the 5' nucleoside of region F'). Gapmers which comprise a disrupted gap typically retain a region of at least 3 or 4 contiguous DNA nucleosides at either the 5' end or 3' end of the gap region. Exemplary designs for gap-breaker oligonucleotides include

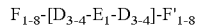
$F_{1-8}$-[$D_{3-4}$-$E_1$-$D_{3-4}$]-$F'_{1-8}$

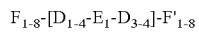
$F_{1-8}$-[$D_{1-4}$-$E_1$-$D_{3-4}$]-$F'_{1-8}$

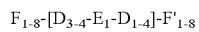
$F_{1-8}$-[$D_{3-4}$-$E_1$-$D_{1-4}$]-$F'_{1-8}$ wherein region G is within the brackets [$D_n$-$E_r$-$D_m$], D is a contiguous sequence of DNA nucleosides, E is a modified nucleoside (the gap-breaker or gap-disrupting nucleoside), and F and F' are the flanking regions as defined herein, and with the proviso that the overall length of the gapmer regions F-G-F' is at least 12, such as at least 14 nucleotides in length. In some embodiments, region G of a gap disrupted gapmer comprises at least 6 DNA nucleosides, such as 6, 7, 8, 9, 10, 11, 12, 13, 14, 15 or 16 DNA nucleosides. As described above, the DNA nucleosides may be contiguous or may optionally be interspersed with one or more modified nucleosides, with the proviso that the gap region G is capable of mediating RNaseH recruitment.

Gapmer—Flanking Regions, F and F'

Region F is positioned immediately adjacent to the 5' DNA nucleoside of region G. The 3' most nucleoside of region F is a sugar modified nucleoside, such as a high affinity sugar modified nucleoside, for example a 2' substituted nucleoside, such as a MOE nucleoside, or an LNA nucleoside.

Region F' is positioned immediately adjacent to the 3' DNA nucleoside of region G. The 5' most nucleoside of region F' is a sugar modified nucleoside, such as a high affinity sugar modified nucleoside, for example a 2' substituted nucleoside, such as a MOE nucleoside, or an LNA nucleoside.

Region F is 1-8 contiguous nucleotides in length, such as 2-6, such as 3-4 contiguous nucleotides in length. Advantageously the 5' most nucleoside of region F is a sugar modified nucleoside. In some embodiments the two 5' most nucleoside of region F are sugar modified nucleoside. In some embodiments the 5' most nucleoside of region F is an LNA nucleoside. In some embodiments the two 5' most nucleoside of region F are LNA nucleosides. In some embodiments the two 5' most nucleoside of region F are 2' substituted nucleoside nucleosides, such as two 3' MOE nucleosides. In some embodiments the 5' most nucleoside of region F is a 2' substituted nucleoside, such as a MOE nucleoside.

Region F' is 2-8 contiguous nucleotides in length, such as 3-6, such as 4-5 contiguous nucleotides in length. Advantageously, embodiments the 3' most nucleoside of region F' is a sugar modified nucleoside. In some embodiments the two 3' most nucleoside of region F' are sugar modified nucleoside. In some embodiments the two 3' most nucleoside of region F' are LNA nucleosides. In some embodiments the 3' most nucleoside of region F' is an LNA nucleoside. In some embodiments the two 3' most nucleoside of region F' are 2' substituted nucleoside nucleosides, such as two 3' MOE nucleosides. In some embodiments the 3' most nucleoside of region F' is a 2' substituted nucleoside, such as a MOE nucleoside. It should be noted that when the length of region F or F' is one, it is advantageously an LNA nucleoside.

In some embodiments, region F and F' independently consists of or comprises a contiguous sequence of sugar modified nucleosides. In some embodiments, the sugar modified nucleosides of region F may be independently selected from 2'-O-alkyl-RNA units, 2'-O-methyl-RNA, 2'-amino-DNA units, 2'-fluoro-DNA units, 2'-alkoxy-RNA, MOE units, LNA units, arabino nucleic acid (ANA) units and 2'-fluoro-ANA units.

In some embodiments, region F and F' independently comprises both LNA and a 2' substituted modified nucleosides (mixed wing design).

In some embodiments, region F and F' consists of only one type of sugar modified nucleosides, such as only MOE or only beta-D-oxy LNA or only ScET. Such designs are also termed uniform flanks or uniform gapmer design.

In some embodiments, all the nucleosides of region F or F', or F and F' are LNA nucleosides, such as independently selected from beta-D-oxy LNA, ENA or ScET nucleosides.

In some embodiments, all the nucleosides of region F or F', or F and F' are 2' substituted nucleosides, such as OMe or MOE nucleosides. In some embodiments region F consists of 1, 2, 3, 4, 5, 6, 7, or 8 contiguous OMe or MOE nucleosides. In some embodiments only one of the flanking regions can consist of 2' substituted nucleosides, such as OMe or MOE nucleosides. In some embodiments it is the 5' (F) flanking region that consists 2' substituted nucleosides, such as OMe or MOE nucleosides whereas the 3' (F') flanking region comprises at least one LNA nucleoside, such as beta-D-oxy LNA nucleosides or cET nucleosides. In some embodiments it is the 3' (F') flanking region that consists 2' substituted nucleosides, such as OMe or MOE nucleosides whereas the 5' (F) flanking region comprises at least one LNA nucleoside, such as beta-D-oxy LNA nucleosides or cET nucleosides. In some embodiments, all the modified nucleosides of region F and F' are LNA nucleosides, such as independently selected from beta-D-oxy LNA, ENA or ScET nucleosides, wherein region F or F', or F and F' may optionally comprise DNA nucleosides (an alternating flank, see definition of these for more details). In some embodiments, all the modified nucleosides of region F and F' are beta-D-oxy LNA nucleosides, wherein region F or F', or F and F' may optionally comprise DNA nucleosides (an alternating flank, see definition of these for more details).

In some embodiments the 5' most and the 3' most nucleosides of region F and F' are LNA nucleosides, such as beta-D-oxy LNA nucleosides or ScET nucleosides.

In some embodiments, the internucleoside linkage between region F and region G is a phosphorothioate internucleoside linkage. In some embodiments, the internucleoside linkage between region F' and region G is a phosphorothioate internucleoside linkage. In some embodiments, the internucleoside linkages between the nucleosides of region F or F', F and F' are phosphorothioate internucleoside linkages.

LNA Gapmer

An LNA gapmer is a gapmer wherein either one or both of region F and F' comprises or consists of LNA nucleosides. A beta-D-oxy gapmer is a gapmer wherein either one or both of region F and F' comprises or consists of beta-D-oxy LNA nucleosides.

In some embodiments the LNA gapmer is of formula: [LNA]$_{1-5}$-[region G]-[LNA]$_{1-5}$, wherein region G is as defined in the Gapmer region G definition.

MOE Gapmers

A MOE gapmers is a gapmer wherein regions F and F' consist of MOE nucleosides. In some embodiments the MOE gapmer is of design [MOE]$_{1-8}$-[Region G]-[MOE]$_{1-8}$, such as [MOE]$_{2-7}$-[Region G]$_{5-16}$-[MOE]$_{2-7}$, such as [MOE]$_{3-6}$-[Region GHMOE]$_{3-6}$, wherein region G is as defined in the Gapmer definition. MOE gapmers with a 5-10-5 design (MOE-DNA-MOE) have been widely used in the art.

Mixed Wing Gapmer

A mixed wing gapmer is an LNA gapmer wherein one or both of region F and F' comprise a 2' substituted nucleoside, such as a 2' substituted nucleoside independently selected from the group consisting of 2'-O-alkyl-RNA units, 2'-O-methyl-RNA, 2'-amino-DNA units, 2'-fluoro-DNA units, 2'-alkoxy-RNA, MOE units, arabino nucleic acid (ANA) units and 2'-fluoro-ANA units, such as a MOE nucleosides. In some embodiments wherein at least one of region F and F', or both region F and F' comprise at least one LNA nucleoside, the remaining nucleosides of region F and F' are independently selected from the group consisting of MOE and LNA. In some embodiments wherein at least one of region F and F', or both region F and F' comprise at least two LNA nucleosides, the remaining nucleosides of region F and F' are independently selected from the group consisting of MOE and LNA. In some mixed wing embodiments, one or both of region F and F' may further comprise one or more DNA nucleosides.

Mixed wing gapmer designs are disclosed in WO2008/049085 and WO2012/109395, both of which are hereby incorporated by reference.

Alternating Flank Gapmers

Oligonucleotides with alternating flanks are LNA gapmer oligonucleotides where at least one of the flanks (F or F') comprises DNA in addition to the LNA nucleoside(s). In some embodiments at least one of region F or F', or both region F and F', comprise both LNA nucleosides and DNA nucleosides. In such embodiments, the flanking region F or F', or both F and F' comprise at least three nucleosides, wherein the 5' and 3' most nucleosides of the F and/or F' region are LNA nucleosides.

In some embodiments at least one of region F or F', or both region F and F', comprise both LNA nucleosides and DNA nucleosides. In such embodiments, the flanking region F or F', or both F and F' comprise at least three nucleosides, wherein the 5' and 3' most nucleosides of the F or F' region are LNA nucleosides, and there is at least one DNA nucleoside positioned between the 5' and 3' most LNA nucleosides of region F or F' (or both region F and F').

Region D' or D" in an Oligonucleotide

The oligonucleotide of the invention may in some embodiments comprise or consist of the contiguous nucleotide sequence of the oligonucleotide which is complementary to the target nucleic acid, such as the gapmer F-G-F', and further 5' and/or 3' nucleosides. The further 5' and/or 3' nucleosides may or may not be fully complementary to the target nucleic acid. Such further 5' and/or 3' nucleosides may be referred to as region D' and D" herein. The addition of region D' or D" may be used for the purpose of joining the contiguous nucleotide sequence, such as the gapmer, to a conjugate moiety or another functional group. When used for joining the contiguous nucleotide sequence with a conjugate moiety is can serve as a biocleavable linker. Alternatively it may be used to provide exonuclease protection or for ease of synthesis or manufacture.

Region D' and D" can be attached to the 5' end of region F or the 3' end of region F', respectively to generate designs of the following formulas D'-F-G-F', F-G-F'-D" or D'-F-G-F'-D". In this instance the F-G-F' is the gapmer portion of the oligonucleotide and region D' or D" constitute a separate part of the oligonucleotide.

Region D' or D" may independently comprise or consist of 1, 2, 3, 4 or 5 additional nucleotides, which may be complementary or non-complementary to the target nucleic acid. The nucleotide adjacent to the F or F' region is not a sugar-modified nucleotide, such as a DNA or RNA or base modified versions of these. The D' or D' region may serve as a nuclease susceptible biocleavable linker (see definition of linkers). In some embodiments the additional 5' and/or 3' end nucleotides are linked with phosphodiester linkages, and are DNA or RNA. Nucleotide based biocleavable linkers suitable for use as region D' or D" are disclosed in WO2014/076195, which include by way of example a phosphodiester linked DNA dinucleotide. The use of biocleavable linkers in poly-oligonucleotide constructs is disclosed in WO2015/113922, where they are used to link multiple antisense constructs (e.g. gapmer regions) within a single oligonucleotide.

In one embodiment the oligonucleotide of the invention comprises a region D' and/or D" in addition to the contiguous nucleotide sequence which constitutes the gapmer.

In some embodiments, the oligonucleotide of the present invention can be represented by the following formulae:

F-G-F'; in particular $F_{1-8}$-$G_{5-16}$-$F'_{2-8}$

D'-F-G-F', in particular $D'_{1-3}$-$F_{1-8}$-$G_{5-16}$-$F'_{2-8}$

F-G-F'-D", in particular $F_{1-8}$-$G_{5-16}$-$F'_{2-6}$-$D''_{1-3}$

D'-F-G-F'-D",in particular D'$_{1-3}$-F$_{1-8}$-G$_{5-16}$-F'$_{2-8}$-D"$_{1-3}$ In some embodiments the internucleoside linkage positioned between region D' and region F is a phosphodiester linkage. In some embodiments the internucleoside linkage positioned between region F' and region D" is a phosphodiester linkage.

Conjugate

The term conjugate as used herein refers to an oligonucleotide which is covalently linked to a non-nucleotide moiety (conjugate moiety or region C or third region).

Conjugation of the oligonucleotide of the invention to one or more non-nucleotide moieties may improve the pharmacology of the oligonucleotide, e.g. by affecting the activity, cellular distribution, cellular uptake or stability of the oligonucleotide. In some embodiments the conjugate moiety modify or enhance the pharmacokinetic properties of the oligonucleotide by improving cellular distribution, bioavailability, metabolism, excretion, permeability, and/or cellular uptake of the oligonucleotide. In particular the conjugate may target the oligonucleotide to a specific organ, tissue or cell type and thereby enhance the effectiveness of the oligonucleotide in that organ, tissue or cell type. At the same time the conjugate may serve to reduce activity of the oligonucleotide in non-target cell types, tissues or organs, e.g. off target activity or activity in non-target cell types, tissues or organs.

In an embodiment, the non-nucleotide moiety (conjugate moiety) is selected from the group consisting of carbohydrates, cell surface receptor ligands, drug substances, hormones, lipophilic substances, polymers, proteins, peptides, toxins (e.g. bacterial toxins), vitamins, viral proteins (e.g. capsids) or combinations thereof.

Linkers

A linkage or linker is a connection between two atoms that links one chemical group or segment of interest to another chemical group or segment of interest via one or more covalent bonds. Conjugate moieties can be attached to the oligonucleotide directly or through a linking moiety (e.g. linker or tether). Linkers serve to covalently connect a third region, e.g. a conjugate moiety (Region C), to a first region, e.g. an oligonucleotide or contiguous nucleotide sequence or gapmer region F-G-F' (region A).

In some embodiments of the invention the conjugate or oligonucleotide conjugate of the invention may optionally, comprise a linker region (second region or region B and/or region Y) which is positioned between the oligonucleotide or contiguous nucleotide sequence complementary to the target nucleic acid (region A or first region) and the conjugate moiety (region C or third region).

Region B refers to biocleavable linkers comprising or consisting of a physiologically labile bond that is cleavable under conditions normally encountered or analogous to those encountered within a mammalian body. Conditions under which physiologically labile linkers undergo chemical transformation (e.g., cleavage) include chemical conditions such as pH, temperature, oxidative or reductive conditions or agents, and salt concentration found in or analogous to those encountered in mammalian cells. Mammalian intracellular conditions also include the presence of enzymatic activity normally present in a mammalian cell such as from proteolytic enzymes or hydrolytic enzymes or nucleases. In one embodiment the biocleavable linker is susceptible to S1 nuclease cleavage. DNA phosphodiester containing biocleavable linkers are described in more detail in WO 2014/076195 (hereby incorporated by reference)—see also region D' or D" herein.

Region Y refers to linkers that are not necessarily biocleavable but primarily serve to covalently connect a conjugate moiety (region C or third region), to an oligonucleotide (region A or first region). The region Y linkers may comprise a chain structure or an oligomer of repeating units such as ethylene glycol, amino acid units or amino alkyl groups. The oligonucleotide conjugates of the present invention can be constructed of the following regional elements A-C, A-B-C, A-B-Y-C, A-Y-B-C or A-Y-C. In some embodiments the linker (region Y) is an amino alkyl, such as a C2-C36 amino alkyl group, including, for example C6 to C12 amino alkyl groups. In a preferred embodiment the linker (region Y) is a C6 amino alkyl group.

Treatment

The term 'treatment' as used herein refers to both treatment of an existing disease (e.g. a disease or disorder as herein referred to), or prevention of a disease, i.e. prophylaxis. It will therefore be recognized that treatment as referred to herein may, in some embodiments, be prophylactic.

DETAILED DESCRIPTION OF THE INVENTION

The invention relates to oligonucleotides, such as antisense oligonucleotides, targeting ATXN3 expression.

The oligonucleotides of the invention targeting ATXN3 are capable of hybridizing to and inhibiting the expression of a ATXN3 target nucleic acid in a cell which is expressing the ATXN3 target nucleic acid.

The ATXN3 target nucleic acid may be a mammalian ATXN3 mRNA or premRNA, such as a human, mouse or monkey ATXN3 mRNA or premRNA. In some embodiments, the ATXN3 target nucleic acid is ATXN3 mRNA or premRNA for example a premRNA or mRNA originating from the *Homo sapiens* Ataxin 3 (ATXN3), RefSeqGene on chromosome 14, exemplified by NCBI Reference Sequence NM_004993.5 (SEQ ID NO 1).

The human ATXN3 pre-mRNA is encoded on *Homo sapiens* Chromosome 14, NC_000014.9 (92058552 . . . 92106621, complement). GENE ID=4287 (ATXN3).

The oligonucleotides of the invention are capable of inhibiting the expression of ATXN3 target nucleic acid, such as the ATXN3 mRNA, in a cell which is expressing the target nucleic acid, such as the ATXN3 mRNA (e.g. a human, monkey or mouse cell).

In some embodiments, the oligonucleotides of the invention are capable of inhibiting the expression of ATXN3 target nucleic acid in a cell which is expressing the target nucleic acid, so to reduce the level of ATXN3 target nucleic acid (e.g. the mRNA) by at least 50%, at least 60%, at least 70%, at least 80%, or at least 90% inhibition compared to the expression level of the ATXN3 target nucleic acid (e.g. the mRNA) in the cell. Suitably the cell is selected from the group consisting of a human cell, a monkey cell and a mouse cell. In some embodiments, the cell is a SK-N-AS, A431, NCI-H23 or ARPE19 cell (for more information on these cells, see Examples). Example 1 provides a suitable assay for evaluating the ability of the oligonucleotides of the invention to inhibit the expression of the target nucleic acid. Suitably the evaluation of a compounds ability to inhibit the expression of the target nucleic acid is performed in vitro, such a gymnotic in vitro assay, for example as according to Example 1.

An aspect of the present invention relates to an antisense oligonucleotide, such as an LNA antisense oligonucleotide gapmer which comprises a contiguous nucleotide sequence of 10 to 30 nucleotides in length with at least 90% complementarity, such as is fully complementary to SEQ ID NO 1, 2 or 3.

In some embodiments, the oligonucleotide comprises a contiguous sequence of 10-30 nucleotides, which is at least 90% complementary, such as at least 91%, such as at least 92%, such as at least 93%, such as at least 94%, such as at least 95%, such as at least 96%, such as at least 97%, such as at least 98%, or 100% complementary with a region of the target nucleic acid or a target sequence. The sequences of suitable target nucleic acids are described herein above.

In some embodiments, the oligonucleotide of the invention comprises a contiguous nucleotides sequence of 12-24, such as 13, 14, 15, 16, 17, 18, 19, 20, 21, 22, or 23, contiguous nucleotides in length, wherein the contiguous nucleotide sequence is fully complementary to a target nucleic acid having a sequence as provided in the section "Taget sequence regions" above.

In some embodiments, the antisense oligonucleotide of the invention comprises a contiguous nucleotides sequence of 12-15, such as 13, or 14, 15 contiguous nucleotides in length, wherein the contiguous nucleotide sequence is fully complementary to a target nucleic acid having a sequence as provided in the section "Taget sequence regions" above.

Typically, the antisense oligonucleotide of the invention or the contiguous nucleotide sequence thereof is a gapmer, such as an LNA gapmer, a mixed wing gapmer, or an alternating flank gapmer.

In some embodiments, the antisense oligonucleotide according to the invention, comprises a contiguous nucleotide sequence of at least 10 contiguous nucleotides, such as at least 12 contiguous nucleotides, such as at least 13 contiguous nucleotides, such as at least 14 contiguous nucleotides, such as at least 15 contiguous nucleotides, which is fully complementary to a target nucleic acid having a sequence selected from the group consisting of SEQ ID NO 16 to SEQ ID NO 1281.

In some embodiments the contiguous nucleotide sequence of the antisense oligonucleotide according to the invention is less than 20 nucleotides in length. In some embodiments the contiguous nucleotide sequence of the antisense oligonucleotide according to the invention is 12-24 nucleotides in length. In some embodiments the contiguous nucleotide sequence of the antisense oligonucleotide according to the invention is 12-22 nucleotides in length. In some embodiments the contiguous nucleotide sequence of the antisense oligonucleotide according to the invention is 12-20 nucleotides in length. In some embodiments the contiguous nucleotide sequence of the antisense oligonucleotide according to the invention is 12-18 nucleotides in length. In some embodiments the contiguous nucleotide sequence of the antisense oligonucleotide according to the invention is 12-16 nucleotides in length.

Advantageously, in some embodiments all of the internucleoside linkages between the nucleosides of the contiguous nucleotide sequence are phosphorothioate internucleoside linkages.

In some embodiments, the contiguous nucleotide sequence is fully complementary to a target nucleic acid.

In some embodiments, the antisense oligonucleotide is a gapmer oligonucleotide comprising a contiguous nucleotide sequence of formula 5'-F-G-F'-3', where region F and F' independently comprise 1-8 sugar modified nucleosides, and G is a region between 5 and 16 nucleosides which are capable of recruiting RNaseH.

In some embodiments, the sugar modified nucleosides of region F and F' are independently selected from the group consisting of 2'-O-alkyl-RNA, 2'-O-methyl-RNA, 2'-alkoxy-RNA, 2'-O-methoxyethyl-RNA, 2'-amino-DNA, 2'-fluoro-DNA, arabino nucleic acid (ANA), 2'-fluoro-ANA and LNA nucleosides.

In some embodiments, region G comprises 5-16 contiguous DNA nucleosides.

In some embodiments, wherein the antisense oligonucleotide is a gapmer oligonucleotide, such as an LNA gapmer oligonucleotide.

In some embodiments, the LNA nucleosides are beta-D-oxy LNA nucleosides.

In some embodiments, the internucleoside linkages between the contiguous nucleotide sequence are phosphorothioate internucleoside linkages.

Preferred sequence motifs and antisense oligonucleotides of the present invention are shown in Table 2 and in the examples.

TABLE 2

Sequence Motifs and Compounds of
Exemplary Compounds of the Invention

| SEQ ID NO | motif sequence | start | end | design | CMP ID NO | Oligonucleotide compound |
|---|---|---|---|---|---|---|
| 4 | aagaaaccaaaccc | 743 | 756 | 2-10-2 | 4_1 | AAgaaaccaaacCC |
| 5 | aaagaaaccaaacc | 744 | 757 | 2-10-2 | 5_1 | AAagaaaccaaaCC |
| 6 | aaaagaaaccaaac | 745 | 758 | 2-10-2 | 6_1 | AAaagaaaccaaAC |
| 7 | caaaagaaaccaaa | 746 | 759 | 2-10-2 | 7_1 | CAaaagaaaccaAA |
| 8 | ccaaaagaaaccaa | 747 | 760 | 2-10-2 | 8_1 | CCaaaagaaaccAA |
| 9 | tccactcctaatac | 803 | 816 | 2-10-2 | 9_1 | TCcactcctaatAC |
| 10 | gtccactcctaata | 804 | 817 | 2-10-2 | 10_1 | GTccactcctaaTA |
| 11 | agtccactcctaat | 805 | 818 | 2-10-2 | 11_1 | AGtccactcctaAT |
| 12 | cagtccactcctaa | 806 | 819 | 2-10-2 | 12_1 | CAgtccactcctAA |
| 13 | ccagtccactccta | 807 | 820 | 2-10-2 | 13_1 | CCagtccactccTA |

TABLE 2-continued

Sequence Motifs and Compounds of
Exemplary Compounds of the Invention

| SEQ ID NO | motif sequence | start | end | design | CMP ID NO | Oligonucleotide compound |
|---|---|---|---|---|---|---|
| 14 | actctttccaaaca | 1012 | 1025 | 2-10-2 | 14_1 | ACtctttccaaaCA |
| 15 | aactctttccaaac | 1013 | 1026 | 2-10-2 | 15_1 | AActctttccaaAC |
| 16 | caactctttccaaa | 1014 | 1027 | 2-10-2 | 16_1 | CAactctttccaAA |
| 17 | gcaactctttccaa | 1015 | 1028 | 2-10-2 | 17_1 | GCaactctttccAA |
| 18 | agcaactctttcca | 1016 | 1029 | 2-10-2 | 18_1 | AGcaactctttcCA |
| 19 | cagcaactctttcc | 1017 | 1030 | 2-10-2 | 19_1 | CAgcaactctttCC |
| 20 | ccagcaactctttc | 1018 | 1031 | 2-10-2 | 20_1 | CCagcaactcttTC |
| 21 | accagcaactcttt | 1019 | 1032 | 2-10-2 | 21_1 | ACcagcaactctTT |
| 22 | ctcctattaaataa | 1040 | 1053 | 2-10-2 | 22_1 | CTcctattaaatAA |
| 23 | cctcctattaaata | 1041 | 1054 | 2-10-2 | 23_1 | CCtcctattaaaTA |
| 24 | tcctcctattaaat | 1042 | 1055 | 2-10-2 | 24_1 | TCctcctattaaAT |
| 25 | ctcctcctattaaa | 1043 | 1056 | 2-10-2 | 25_1 | CTcctcctattaAA |
| 26 | gctcctcctattaa | 1044 | 1057 | 2-10-2 | 26_1 | GCtcctcctattAA |
| 27 | tgctcctcctatta | 1045 | 1058 | 2-10-2 | 27_1 | TGctcctcctatTA |
| 28 | ttgctcctcctatt | 1046 | 1059 | 2-10-2 | 28_1 | TTgctcctcctaTT |
| 29 | tttgctcctcctat | 1047 | 1060 | 2-10-2 | 29_1 | TTtgctcctcctAT |
| 30 | ctttgctcctccta | 1048 | 1061 | 2-10-2 | 30_1 | CTttgctcctccTA |
| 31 | cctttgctcctcct | 1049 | 1062 | 2-10-2 | 31_1 | CCtttgctcctcCT |
| 32 | ccctttgctcctcc | 1050 | 1063 | 2-10-2 | 32_1 | CCctttgctcctCC |
| 33 | accctttgctcctc | 1051 | 1064 | 2-10-2 | 33_1 | ACcctttgctccTC |
| 34 | aaccctttgctcct | 1052 | 1065 | 2-10-2 | 34_1 | AAccctttgctcCT |
| 35 | aaaccctttgctcc | 1053 | 1066 | 2-10-2 | 35_1 | AAaccctttgctCC |
| 36 | aaaaccctttgctc | 1054 | 1067 | 2-10-2 | 36_1 | AAaaccctttgcTC |
| 37 | aaaaaccctttgct | 1055 | 1068 | 2-10-2 | 37_1 | AAaaaccctttgCT |
| 38 | caaaaaccctttgc | 1056 | 1069 | 2-10-2 | 38_1 | CAaaaaccctttGC |
| 39 | acaaaaaccctttg | 1057 | 1070 | 2-10-2 | 39_1 | ACaaaaaccctTTG |
| 40 | aacaaaaacccttt | 1058 | 1071 | 2-10-2 | 40_1 | AAcaaaaaccctTT |
| 41 | aaacaaaaaccctt | 1059 | 1072 | 2-10-2 | 41_1 | AAacaaaaacccTT |
| 42 | aaaacaaaaaccct | 1060 | 1073 | 2-10-2 | 42_1 | AAaacaaaaaccCT |
| 43 | taaaacaaaaaccc | 1061 | 1074 | 2-10-2 | 43_1 | TAaaacaaaaaCC |
| 44 | ataaaacaaaaacc | 1062 | 1075 | 2-10-2 | 44_1 | ATaaaacaaaaaCC |
| 45 | aataaaacaaaaac | 1063 | 1076 | 2-10-2 | 45_1 | AAtaaaacaaaaAC |
| 46 | taataaaacaaaaa | 1064 | 1077 | 2-10-2 | 46_1 | TAataaaacaaaAA |
| 47 | ttaataaaacaaaa | 1065 | 1078 | 2-10-2 | 47_1 | TTaataaaacaaAA |
| 48 | tttaataaaacaaa | 1066 | 1079 | 2-10-2 | 48_1 | TTtaataaaacaAA |
| 49 | atttaataaaacaa | 1067 | 1080 | 2-10-2 | 49_1 | ATttaataaaacAA |
| 50 | ttaaaataaaaatt | 1194 | 1207 | 2-10-2 | 50_1 | TTaaaataaaaaTT |

TABLE 2-continued

Sequence Motifs and Compounds of
Exemplary Compounds of the Invention

| SEQ ID NO | motif sequence | start | end | design | CMP ID NO | Oligonucleotide compound |
|---|---|---|---|---|---|---|
| 51 | tttaaaataaaaat | 1195 | 1208 | 2-10-2 | 51_1 | TTaaaataaaAT |
| 52 | ctttaaaataaaaa | 1196 | 1209 | 2-10-2 | 52_1 | CTttaaaataaaAA |
| 53 | tctttaaaataaaa | 1197 | 1210 | 2-10-2 | 53_1 | TCtttaaaataaAA |
| 54 | atctttaaaataaa | 1198 | 1211 | 2-10-2 | 54_1 | ATctttaaaataAA |
| 55 | catctttaaaataa | 1199 | 1212 | 2-10-2 | 55_1 | CAtctttaaaatAA |
| 56 | ccatctttaaaata | 1200 | 1213 | 2-10-2 | 56_1 | CCatctttaaaaTA |
| 57 | tctaacttaataaa | 2886 | 2899 | 2-10-2 | 57_1 | TCtaacttaataAA |
| 58 | ttctaacttaataa | 2887 | 2900 | 2-10-2 | 58_1 | TTctaacttaatAA |
| 59 | attctaacttaata | 2888 | 2901 | 2-10-2 | 59_1 | ATtctaacttaaTA |
| 60 | cattctaacttaat | 2889 | 2902 | 2-10-2 | 60_1 | CAttctaacttaAT |
| 61 | acattctaacttaa | 2890 | 2903 | 2-10-2 | 61_1 | ACattctaacttAA |
| 62 | tacattctaactta | 2891 | 2904 | 2-10-2 | 62_1 | TAcattctaactTA |
| 63 | ttacattctaactt | 2892 | 2905 | 2-10-2 | 63_1 | TTacattctaacTT |
| 64 | tttacattctaact | 2893 | 2906 | 2-10-2 | 64_1 | TTtacattctaaCT |
| 65 | ttttacattctaac | 2894 | 2907 | 2-10-2 | 65_1 | TTttacattctaAC |
| 66 | tttttacattctaa | 2895 | 2908 | 2-10-2 | 66_1 | TTtttacattctAA |
| 67 | gtttttacattcta | 2896 | 2909 | 2-10-2 | 67_1 | GTttttacattcTA |
| 68 | tgtttttacattct | 2897 | 2910 | 2-10-2 | 68_1 | TGtttttacattCT |
| 69 | ctgtttttacattc | 2898 | 2911 | 2-10-2 | 69_1 | CTgtttttacatTC |
| 70 | ttcaaatatttatt | 2969 | 2982 | 2-10-2 | 70_1 | TTcaaatatttaTT |
| 71 | attcaaatatttat | 2970 | 2983 | 2-10-2 | 71_1 | ATtcaaatatttAT |
| 72 | cattcaaatattta | 2971 | 2984 | 2-10-2 | 72_1 | CAttcaaatattTA |
| 73 | ccattcaaatattt | 2972 | 2985 | 2-10-2 | 73_1 | CCattcaaatatTT |
| 74 | cccattcaaatatt | 2973 | 2986 | 2-10-2 | 74_1 | CCcattcaaataTT |
| 75 | ccccattcaaatat | 2974 | 2987 | 2-10-2 | 75_1 | CCcattcaaatAT |
| 76 | gccccattcaaata | 2975 | 2988 | 2-10-2 | 76_1 | GCcccattcaaaTA |
| 77 | tatacatttttttc | 3173 | 3186 | 2-10-2 | 77_1 | TAtacattttttTC |
| 78 | atatacatttttt | 3174 | 3187 | 2-10-2 | 78_1 | ATatacattttTT |
| 79 | tatatacattttt | 3175 | 3188 | 2-10-2 | 79_1 | TAtatacattttTT |
| 80 | atatatacatttt | 3176 | 3189 | 2-10-2 | 80_1 | ATatatacatttTT |
| 81 | aatatatacatttt | 3177 | 3190 | 2-10-2 | 81_1 | AAtatatacattTT |
| 82 | aaatatatacattt | 3178 | 3191 | 2-10-2 | 82_1 | AAatatatacatTT |
| 83 | caaatatatacatt | 3179 | 3192 | 2-10-2 | 83_1 | CAaatatatacaTT |
| 84 | tcaaatatatacat | 3180 | 3193 | 2-10-2 | 84_1 | TCaaatatatacAT |
| 85 | ttcaaatatataca | 3181 | 3194 | 2-10-2 | 85_1 | TTcaaatatataCA |
| 86 | attcaaatatatac | 3182 | 3195 | 2-10-2 | 86_1 | ATtcaaatatatAC |
| 87 | cattcaaatatata | 3183 | 3196 | 2-10-2 | 87_1 | CAttcaaatataTA |

TABLE 2-continued

Sequence Motifs and Compounds of
Exemplary Compounds of the Invention

| SEQ ID NO | motif sequence | start | end | design | CMP ID NO | Oligonucleotide compound |
|---|---|---|---|---|---|---|
| 88 | ccattcaaatatat | 3184 | 3197 | 2-10-2 | 88_1 | CCattcaaatatAT |
| 89 | tccattcaaatata | 3185 | 3198 | 2-10-2 | 89_1 | TCcattcaaataTA |
| 90 | atccattcaaatat | 3186 | 3199 | 2-10-2 | 90_1 | ATccattcaaatAT |
| 91 | tatccattcaaata | 3187 | 3200 | 2-10-2 | 91_1 | TAtccattcaaaTA |
| 92 | ttatccattcaaat | 3188 | 3201 | 2-10-2 | 92_1 | TTatccattcaaAT |
| 93 | tttatccattcaaa | 3189 | 3202 | 2-10-2 | 93_1 | TTtatccattcAA |
| 94 | ctttatccattcaa | 3190 | 3203 | 2-10-2 | 94_1 | CTttatccattcAA |
| 95 | tctttatccattca | 3191 | 3204 | 2-10-2 | 95_1 | TCtttatccattCA |
| 96 | ctctttatccattc | 3192 | 3205 | 2-10-2 | 96_1 | CTctttatccatTC |
| 97 | tctctttatccatt | 3193 | 3206 | 2-10-2 | 97_1 | TCtctttatccaTT |
| 98 | ccatatatatctca | 3221 | 3234 | 2-10-2 | 98_1 | CCatatatatctCA |
| 99 | accatatatatctc | 3222 | 3235 | 2-10-2 | 99_1 | ACcatatatatcTC |
| 100 | caccatatatatct | 3223 | 3236 | 2-10-2 | 100_1 | CAccatatatatCT |
| 101 | gcaccatatatatc | 3224 | 3237 | 2-10-2 | 101_1 | GCaccatatataTC |
| 102 | agcaccatatatat | 3225 | 3238 | 2-10-2 | 102_1 | AGcaccatatatAT |
| 103 | cagcaccatatata | 3226 | 3239 | 2-10-2 | 103_1 | CAgcaccatataTA |
| 104 | acagcaccatatat | 3227 | 3240 | 2-10-2 | 104_1 | ACagcaccatatAT |
| 105 | aacagcaccatata | 3228 | 3241 | 2-10-2 | 105_1 | AAcagcaccataTA |
| 106 | aaaacaaacaacaa | 3462 | 3475 | 2-10-2 | 106_1 | AAaacaaacaacAA |
| 107 | taaaacaaacaaca | 3463 | 3476 | 2-10-2 | 107_1 | TAaaacaaacaaCA |
| 108 | ctaaaacaaacaac | 3464 | 3477 | 2-10-2 | 108_1 | CTaaaacaaacaAC |
| 109 | actaaaacaaacaa | 3465 | 3478 | 2-10-2 | 109_1 | ACtaaaacaaacAA |
| 110 | aactaaaacaaaca | 3466 | 3479 | 2-10-2 | 110_1 | AActaaaacaaaCA |
| 111 | gaactaaaacaaac | 3467 | 3480 | 2-10-2 | 111_1 | GAactaaaacaaAC |
| 112 | agaactaaaacaaa | 3468 | 3481 | 2-10-2 | 112_1 | AGaactaaaacaAA |
| 113 | cagaactaaaacaa | 3469 | 3482 | 2-10-2 | 113_1 | CAgaactaaaacAA |
| 114 | ccagaactaaaaca | 3470 | 3483 | 2-10-2 | 114_1 | CCagaactaaaaCA |
| 115 | accagaactaaaac | 3471 | 3484 | 2-10-2 | 115_1 | ACcagaactaaaAC |
| 116 | atgttattatcccc | 3882 | 3895 | 2-10-2 | 116_1 | ATgttattatcCC |
| 117 | tatgttattatccc | 3883 | 3896 | 2-10-2 | 117_1 | TAtgttattatcCC |
| 118 | ctatgttattatcc | 3884 | 3897 | 2-10-2 | 118_1 | CTatgttattatCC |
| 119 | tctatgttattatc | 3885 | 3898 | 2-10-2 | 119_1 | TCtatgttattaTC |
| 120 | tacactctaactct | 3908 | 3921 | 2-10-2 | 120_1 | TAcactctaactCT |
| 121 | ctacactctaactc | 3909 | 3922 | 2-10-2 | 121_1 | CTacactctaacTC |
| 122 | tctacactctaact | 3910 | 3923 | 2-10-2 | 122_1 | TCtacactctaaCT |
| 123 | ctctacactctaac | 3911 | 3924 | 2-10-2 | 123_1 | CTctacactctaAC |
| 124 | tctctacactctaa | 3912 | 3925 | 2-10-2 | 124_1 | TCtctacactctAA |

TABLE 2-continued

Sequence Motifs and Compounds of
Exemplary Compounds of the Invention

| SEQ ID NO | motif sequence | start | end | design | CMP ID NO | Oligonucleotide compound |
|---|---|---|---|---|---|---|
| 125 | ttctctacactcta | 3913 | 3926 | 2-10-2 | 125_1 | TTctctacactcTA |
| 126 | cttctctacactct | 3914 | 3927 | 2-10-2 | 126_1 | CTtctctacactCT |
| 127 | ccttctctacactc | 3915 | 3928 | 2-10-2 | 127_1 | CCttctctacacTC |
| 128 | tacaacacaaatca | 4102 | 4115 | 2-10-2 | 128_1 | TAcaacacaaatCA |
| 129 | ctacaacacaaatc | 4103 | 4116 | 2-10-2 | 129_1 | CTacaacacaaaTC |
| 130 | actacaacacaaat | 4104 | 4117 | 2-10-2 | 130_1 | ACtacaacacaaAT |
| 131 | aactacaacacaaa | 4105 | 4118 | 2-10-2 | 131_1 | AActacaacacaAA |
| 132 | taactacaacacaa | 4106 | 4119 | 2-10-2 | 132_1 | TAactacaacacAA |
| 133 | ctaactacaacaca | 4107 | 4120 | 2-10-2 | 133_1 | CTaactacaacaCA |
| 134 | actaactacaacac | 4108 | 4121 | 2-10-2 | 134_1 | ACtaactacaacAC |
| 135 | tactaactacaaca | 4109 | 4122 | 2-10-2 | 135_1 | TActaactacaaCA |
| 136 | ctactaactacaac | 4110 | 4123 | 2-10-2 | 136_1 | CTactaactacaAC |
| 137 | actactaactacaa | 4111 | 4124 | 2-10-2 | 137_1 | ACtactaactacAA |
| 138 | cactactaactaca | 4112 | 4125 | 2-10-2 | 138_1 | CActactaactaCA |
| 139 | acactactaactac | 4113 | 4126 | 2-10-2 | 139_1 | ACactactaactAC |
| 140 | gacactactaacta | 4114 | 4127 | 2-10-2 | 140_1 | GAcactactaacTA |
| 141 | agacactactaact | 4115 | 4128 | 2-10-2 | 141_1 | AGacactactaaCT |
| 142 | tttaccccaacct | 4173 | 4186 | 2-10-2 | 142_1 | TTtaccccaacCT |
| 143 | atttaccccaacc | 4174 | 4187 | 2-10-2 | 143_1 | ATttaccccaaCC |
| 144 | catttaccccaac | 4175 | 4188 | 2-10-2 | 144_1 | CAtttaccccaAC |
| 145 | tcatttaccccaa | 4176 | 4189 | 2-10-2 | 145_1 | TCatttaccccAA |
| 146 | atcatttacccca | 4177 | 4190 | 2-10-2 | 146_1 | ATcatttaccccCA |
| 147 | aatcatttaccccc | 4178 | 4191 | 2-10-2 | 147_1 | AAtcatttacccCC |
| 148 | aaatcatttacccc | 4179 | 4192 | 2-10-2 | 148_1 | AAatcatttaccCC |
| 149 | caaatcatttaccc | 4180 | 4193 | 2-10-2 | 149_1 | CAaatcatttacCC |
| 150 | ccaaatcatttacc | 4181 | 4194 | 2-10-2 | 150_1 | CCaaatcatttaCC |
| 151 | accaaatcatttac | 4182 | 4195 | 2-10-2 | 151_1 | ACcaaatcatttAC |
| 152 | taccaaatcattta | 4183 | 4196 | 2-10-2 | 152_1 | TAccaaatcattTA |
| 153 | ctaccaaatcattt | 4184 | 4197 | 2-10-2 | 153_1 | CTaccaaatcatTT |
| 154 | gctaccaaatcatt | 4185 | 4198 | 2-10-2 | 154_1 | GCtaccaaatcaTT |
| 155 | tgctaccaaatcat | 4186 | 4199 | 2-10-2 | 155_1 | TGctaccaaatcAT |
| 156 | ctgctaccaaatca | 4187 | 4200 | 2-10-2 | 156_1 | CTgctaccaaatCA |
| 157 | actgctaccaaatc | 4188 | 4201 | 2-10-2 | 157_1 | ACtgctaccaaaTC |
| 158 | aactgctaccaaat | 4189 | 4202 | 2-10-2 | 158_1 | AActgctaccaaAT |
| 159 | aagctttaatcaaa | 5102 | 5115 | 2-10-2 | 159_1 | AAgctttaatcaAA |
| 160 | caagctttaatcaa | 5103 | 5116 | 2-10-2 | 160_1 | CAagctttaatcAA |
| 161 | tcaagctttaatca | 5104 | 5117 | 2-10-2 | 161_1 | TCaagctttaatCA |

TABLE 2-continued

Sequence Motifs and Compounds of
Exemplary Compounds of the Invention

| SEQ ID NO | motif sequence | start | end | design | CMP ID NO | Oligonucleotide compound |
|---|---|---|---|---|---|---|
| 162 | atcaagctttaatc | 5105 | 5118 | 2-10-2 | 162_1 | ATcaagctttaaTC |
| 163 | catcaagctttaat | 5106 | 5119 | 2-10-2 | 163_1 | CAtcaagctttaAT |
| 164 | tcaaactatcccca | 5131 | 5144 | 2-10-2 | 164_1 | TCaaactatcccCA |
| 165 | ctcaaactatcccc | 5132 | 5145 | 2-10-2 | 165_1 | CTcaaactatccCC |
| 166 | tctcaaactatccc | 5133 | 5146 | 2-10-2 | 166_1 | TCtcaaactatcCC |
| 167 | atctcaaactatcc | 5134 | 5147 | 2-10-2 | 167_1 | ATctcaaactatCC |
| 168 | tatctcaaactatc | 5135 | 5148 | 2-10-2 | 168_1 | TAtctcaaactaTC |
| 169 | ttatctcaaactat | 5136 | 5149 | 2-10-2 | 169_1 | TTatctcaaactAT |
| 170 | cttatctcaaacta | 5137 | 5150 | 2-10-2 | 170_1 | CTtatctcaaacTA |
| 171 | ccttatctcaaact | 5138 | 5151 | 2-10-2 | 171_1 | CCttatctcaaaCT |
| 172 | cccttatctcaaac | 5139 | 5152 | 2-10-2 | 172_1 | CCcttatctcaaAC |
| 173 | gcccttatctcaaa | 5140 | 5153 | 2-10-2 | 173_1 | GCccttatctcaAA |
| 174 | tgcccttatctcaa | 5141 | 5154 | 2-10-2 | 174_1 | TGcccttatctcAA |
| 175 | caaacttcatcaaa | 5540 | 5553 | 2-10-2 | 175_1 | CAaacttcatcaAA |
| 176 | tcaaacttcatcaa | 5541 | 5554 | 2-10-2 | 176_1 | TCaaacttcatcAA |
| 177 | atcaaacttcatca | 5542 | 5555 | 2-10-2 | 177_1 | ATcaaacttcatCA |
| 178 | aatcaaacttcatc | 5543 | 5556 | 2-10-2 | 178_1 | AAtcaaacttcaTC |
| 179 | aaatcaaacttcat | 5544 | 5557 | 2-10-2 | 179_1 | AAatcaaacttcAT |
| 180 | gaaatcaaacttca | 5545 | 5558 | 2-10-2 | 180_1 | GAaatcaaacttCA |
| 181 | tgaaatcaaacttc | 5546 | 5559 | 2-10-2 | 181_1 | TGaaatcaaactTC |
| 182 | ttgaaatcaaactt | 5547 | 5560 | 2-10-2 | 182_1 | TTgaaatcaaacTT |
| 183 | aacacaaatttcct | 5693 | 5706 | 2-10-2 | 183_1 | AAcacaaatttcCT |
| 184 | taacacaaatttcc | 5694 | 5707 | 2-10-2 | 184_1 | TAacacaaatttCC |
| 185 | ctaacacaaatttc | 5695 | 5708 | 2-10-2 | 185_1 | CTaacacaaattTC |
| 186 | gctaacacaaattt | 5696 | 5709 | 2-10-2 | 186_1 | GCtaacacaaatTT |
| 187 | tgctaacacaaatt | 5697 | 5710 | 2-10-2 | 187_1 | TGctaacacaaaTT |
| 188 | ttgctaacacaaat | 5698 | 5711 | 2-10-2 | 188_1 | TTgctaacacaaAT |
| 189 | tttgctaacacaaa | 5699 | 5712 | 2-10-2 | 189_1 | TTtgctaacacaAA |
| 190 | ctttgctaacacaa | 5700 | 5713 | 2-10-2 | 190_1 | CTttgctaacacAA |
| 191 | cctttgctaacaca | 5701 | 5714 | 2-10-2 | 191_1 | CCtttgctaacaCA |
| 192 | taactaataattat | 6417 | 6430 | 2-10-2 | 192_1 | TAactaataattAT |
| 193 | ataactaataatta | 6418 | 6431 | 2-10-2 | 193_1 | ATaactaataatTA |
| 194 | aataactaataatt | 6419 | 6432 | 2-10-2 | 194_1 | AAtaactaataaTT |
| 195 | taataactaataat | 6420 | 6433 | 2-10-2 | 195_1 | TAataactaataAT |
| 196 | ataataactaataa | 6421 | 6434 | 2-10-2 | 196_1 | ATaataactaatAA |
| 197 | aataataactaata | 6422 | 6435 | 2-10-2 | 197_1 | AAtaataactaaTA |
| 198 | caataataactaat | 6423 | 6436 | 2-10-2 | 198_1 | CAataataactaAT |

TABLE 2-continued

Sequence Motifs and Compounds of
Exemplary Compounds of the Invention

| SEQ ID NO | motif sequence | start | end | design | CMP ID NO | Oligonucleotide compound |
|---|---|---|---|---|---|---|
| 199 | ccaataataactaa | 6424 | 6437 | 2-10-2 | 199_1 | CCaataataactAA |
| 200 | accaataataacta | 6425 | 6438 | 2-10-2 | 200_1 | ACcaataataacTA |
| 201 | aaccaataataact | 6426 | 6439 | 2-10-2 | 201_1 | AAccaataataaCT |
| 202 | taaccaataataac | 6427 | 6440 | 2-10-2 | 202_1 | TAaccaataataAC |
| 203 | ataaccaataataa | 6428 | 6441 | 2-10-2 | 203_1 | ATaaccaataatAA |
| 204 | tataaccaataata | 6429 | 6442 | 2-10-2 | 204_1 | TAtaaccaataaTA |
| 205 | gtataaccaataat | 6430 | 6443 | 2-10-2 | 205_1 | GTataaccaataAT |
| 206 | acatcacacaattt | 7415 | 7428 | 2-10-2 | 206_1 | ACatcacacaatTT |
| 207 | gacatcacacaatt | 7416 | 7429 | 2-10-2 | 207_1 | GAcatcacacaaTT |
| 208 | tgacatcacacaat | 7417 | 7430 | 2-10-2 | 208_1 | TGacatcacacaAT |
| 209 | ctgacatcacacaa | 7418 | 7431 | 2-10-2 | 209_1 | CTgacatcacacAA |
| 210 | tctgacatcacaca | 7419 | 7432 | 2-10-2 | 210_1 | TCtgacatcacaCA |
| 211 | atctgacatcacac | 7420 | 7433 | 2-10-2 | 211_1 | ATctgacatcacAC |
| 212 | ttccttaacccaac | 7436 | 7449 | 2-10-2 | 212_1 | TTccttaacccaAC |
| 213 | attccttaacccaa | 7437 | 7450 | 2-10-2 | 213_1 | ATtccttaacccAA |
| 214 | tattccttaaccca | 7438 | 7451 | 2-10-2 | 214_1 | TAttccttaaccCA |
| 215 | ctattccttaaccc | 7439 | 7452 | 2-10-2 | 215_1 | CTattccttaacCC |
| 216 | tctattccttaacc | 7440 | 7453 | 2-10-2 | 216_1 | TCtattccttaaCC |
| 217 | gtctattccttaac | 7441 | 7454 | 2-10-2 | 217_1 | GTctattccttaAC |
| 218 | catcaaatctcata | 8609 | 8622 | 2-10-2 | 218_1 | CAtcaaatctcaTA |
| 219 | gcatcaaatctcat | 8610 | 8623 | 2-10-2 | 219_1 | GCatcaaatctcAT |
| 220 | tgcatcaaatctca | 8611 | 8624 | 2-10-2 | 220_1 | TGcatcaaatctCA |
| 221 | atgcatcaaatctc | 8612 | 8625 | 2-10-2 | 221_1 | ATgcatcaaatcTC |
| 222 | aatgcatcaaatct | 8613 | 8626 | 2-10-2 | 222_1 | AAtgcatcaaatCT |
| 223 | attttaaacaaaca | 8637 | 8650 | 2-10-2 | 223_1 | ATtttaaacaaaCA |
| 224 | tattttaaacaaac | 8638 | 8651 | 2-10-2 | 224_1 | TAttttaaacaaAC |
| 225 | ttattttaaacaaa | 8639 | 8652 | 2-10-2 | 225_1 | TTattttaaacaAA |
| 226 | attattttaaacaa | 8640 | 8653 | 2-10-2 | 226_1 | ATtattttaaacAA |
| 227 | aattattttaaaca | 8641 | 8654 | 2-10-2 | 227_1 | AAttattttaaaCA |
| 228 | gaattattttaaac | 8642 | 8655 | 2-10-2 | 228_1 | GAattattttaaAC |
| 229 | ttttacaaatctac | 8693 | 8706 | 2-10-2 | 229_1 | TTttacaaatctAC |
| 230 | attttacaaatcta | 8694 | 8707 | 2-10-2 | 230_1 | ATtttacaaatcTA |
| 231 | tattttacaaatct | 8695 | 8708 | 2-10-2 | 231_1 | TAttttacaaatCT |
| 232 | ttattttacaaatc | 8696 | 8709 | 2-10-2 | 232_1 | TTattttacaaaTC |
| 233 | tttattttacaaat | 8697 | 8710 | 2-10-2 | 233_1 | TTtattttacaaAT |
| 234 | atttattttacaaa | 8698 | 8711 | 2-10-2 | 234_1 | ATttattttacaAA |
| 235 | catttattttacaa | 8699 | 8712 | 2-10-2 | 235_1 | CAtttattttacAA |

TABLE 2-continued

Sequence Motifs and Compounds of
Exemplary Compounds of the Invention

| SEQ ID NO | motif sequence | start | end | design | CMP ID NO | Oligonucleotide compound |
|---|---|---|---|---|---|---|
| 236 | acatttattttaca | 8700 | 8713 | 2-10-2 | 236_1 | ACatttattttaCA |
| 237 | aacatttattttac | 8701 | 8714 | 2-10-2 | 237_1 | AAcatttattttAC |
| 238 | taacatttattta | 8702 | 8715 | 2-10-2 | 238_1 | TAacatttatttTA |
| 239 | aatttaatcattaa | 9391 | 9404 | 2-10-2 | 239_1 | AAtttaatcattAA |
| 240 | taatttaatcatta | 9392 | 9405 | 2-10-2 | 240_1 | TAatttaatcatTA |
| 241 | ataatttaatcatt | 9393 | 9406 | 2-10-2 | 241_1 | ATaatttaatcaTT |
| 242 | aataatttaatcat | 9394 | 9407 | 2-10-2 | 242_1 | AAtaatttaatcAT |
| 243 | aaataatttaatca | 9395 | 9408 | 2-10-2 | 243_1 | AAataatttaatCA |
| 244 | taaataatttaatc | 9396 | 9409 | 2-10-2 | 244_1 | TAaataatttaaTC |
| 245 | ctaaataatttaat | 9397 | 9410 | 2-10-2 | 245_1 | CTaaataatttaAT |
| 246 | cctaaataatttaa | 9398 | 9411 | 2-10-2 | 246_1 | CCtaaataatttAA |
| 247 | ccctaaataattta | 9399 | 9412 | 2-10-2 | 247_1 | CCctaaataattTA |
| 248 | cccctaaataattt | 9400 | 9413 | 2-10-2 | 248_1 | CCcctaaataatTT |
| 249 | tccctaaataatt | 9401 | 9414 | 2-10-2 | 249_1 | TCccctaaataaTT |
| 250 | tatataaaatcta | 10958 | 10971 | 2-10-2 | 250_1 | TAtataaaatcTA |
| 251 | ctatataaaatct | 10959 | 10972 | 2-10-2 | 251_1 | CTatataaaatCT |
| 252 | tctatataaaaatc | 10960 | 10973 | 2-10-2 | 252_1 | TCtatataaaaTC |
| 253 | atctatataaaat | 10961 | 10974 | 2-10-2 | 253_1 | ATctatataaaAT |
| 254 | tatctatataaaaa | 10962 | 10975 | 2-10-2 | 254_1 | TAtctatataaAA |
| 255 | ttatctatataaaa | 10963 | 10976 | 2-10-2 | 255_1 | TTatctatataaAA |
| 256 | tttatctatataaa | 10964 | 10977 | 2-10-2 | 256_1 | TTtatctatataAA |
| 257 | ccccactctaatat | 11001 | 11014 | 2-10-2 | 257_1 | CCccactctaatAT |
| 258 | gccccactctaata | 11002 | 11015 | 2-10-2 | 258_1 | GCcccactctaaTA |
| 259 | tgccccactctaat | 11003 | 11016 | 2-10-2 | 259_1 | TGccccactctaAT |
| 260 | atgccccactctaa | 11004 | 11017 | 2-10-2 | 260_1 | ATgccccactctAA |
| 261 | aatgccccactcta | 11005 | 11018 | 2-10-2 | 261_1 | AAtgccccactcTA |
| 262 | aaatgccccactct | 11006 | 11019 | 2-10-2 | 262_1 | AAatgccccactCT |
| 263 | taaatgccccactc | 11007 | 11020 | 2-10-2 | 263_1 | TAaatgccccacTC |
| 264 | ttaaatgccccact | 11008 | 11021 | 2-10-2 | 264_1 | TTaaatgccccaCT |
| 265 | atataaccaccaaa | 11546 | 11559 | 2-10-2 | 265_1 | ATataaccaccaAA |
| 266 | tatataaccaccaa | 11547 | 11560 | 2-10-2 | 266_1 | TAtataaccaccAA |
| 267 | atatataaccacca | 11548 | 11561 | 2-10-2 | 267_1 | ATatataaccacCA |
| 268 | tatatataaccacc | 11549 | 11562 | 2-10-2 | 268_1 | TAtatataaccaCC |
| 269 | atatatataaccac | 11550 | 11563 | 2-10-2 | 269_1 | ATatatataaccAC |
| 270 | aaaattcactatct | 11942 | 11955 | 2-10-2 | 270_1 | AAaattcactatCT |
| 271 | gaaaattcactatc | 11943 | 11956 | 2-10-2 | 271_1 | GAaaattcactaTC |
| 272 | tgaaaattcactat | 11944 | 11957 | 2-10-2 | 272_1 | TGaaaattcactAT |

TABLE 2-continued

Sequence Motifs and Compounds of
Exemplary Compounds of the Invention

| SEQ ID NO | motif sequence | start | end | design | CMP ID NO | Oligonucleotide compound |
|---|---|---|---|---|---|---|
| 273 | ctgaaaattcacta | 11945 | 11958 | 2-10-2 | 273_1 | CTgaaaattcacTA |
| 274 | tctgaaaattcact | 11946 | 11959 | 2-10-2 | 274_1 | TCtgaaaattcaCT |
| 275 | tactatatacatct | 12176 | 12189 | 2-10-2 | 275_1 | TActatatacatCT |
| 276 | ctactatatacatc | 12177 | 12190 | 2-10-2 | 276_1 | CTactatatacaTC |
| 277 | tctactatatacat | 12178 | 12191 | 2-10-2 | 277_1 | TCtactatatacAT |
| 278 | gtctactatataca | 12179 | 12192 | 2-10-2 | 278_1 | GTctactatataCA |
| 279 | agtctactatatac | 12180 | 12193 | 2-10-2 | 279_1 | AGtctactatatAC |
| 280 | tagtctactatata | 12181 | 12194 | 2-10-2 | 280_1 | TAgtctactataTA |
| 281 | ctagtctactatat | 12182 | 12195 | 2-10-2 | 281_1 | CTagtctactatAT |
| 282 | actagtctactata | 12183 | 12196 | 2-10-2 | 282_1 | ACtagtctactaTA |
| 283 | aactagtctactat | 12184 | 12197 | 2-10-2 | 283_1 | AActagtctactAT |
| 284 | tattctacccataa | 12211 | 12224 | 2-10-2 | 284_1 | TAttctacccatAA |
| 285 | atattctacccata | 12212 | 12225 | 2-10-2 | 285_1 | ATattctacccaTA |
| 286 | tatattctacccat | 12213 | 12226 | 2-10-2 | 286_1 | TAtattctacccAT |
| 287 | gtatattctaccca | 12214 | 12227 | 2-10-2 | 287_1 | GTatattctaccCA |
| 288 | tgtatattctaccc | 12215 | 12228 | 2-10-2 | 288_1 | TGtatattctacCC |
| 289 | atgtatattctacc | 12216 | 12229 | 2-10-2 | 289_1 | ATgtatattctaCC |
| 290 | ccacacaattccta | 12254 | 12267 | 2-10-2 | 290_1 | CCacacaattccTA |
| 291 | accacacaattcct | 12255 | 12268 | 2-10-2 | 291_1 | ACcacacaattcCT |
| 292 | aaccacacaattcc | 12256 | 12269 | 2-10-2 | 292_1 | AAccacacaattCC |
| 293 | aaaccacacaattc | 12257 | 12270 | 2-10-2 | 293_1 | AAaccacacaatTC |
| 294 | aaaaccacacaatt | 12258 | 12271 | 2-10-2 | 294_1 | AAaaccacacaaTT |
| 295 | gaaaaccacacaat | 12259 | 12272 | 2-10-2 | 295_1 | GAaaaccacacaAT |
| 296 | agaaaaccacacaa | 12260 | 12273 | 2-10-2 | 296_1 | AGaaaaccacacAA |
| 297 | cagaaaaccacaca | 12261 | 12274 | 2-10-2 | 297_1 | CAgaaaaccacaCA |
| 298 | ccagaaaaccacac | 12262 | 12275 | 2-10-2 | 298_1 | CCagaaaaccacAC |
| 299 | tccagaaaaccaca | 12263 | 12276 | 2-10-2 | 299_1 | TCcagaaaaccaCA |
| 300 | aaatccataaaaaa | 12327 | 12340 | 2-10-2 | 300_1 | AAatccataaaaAA |
| 301 | taaatccataaaaa | 12328 | 12341 | 2-10-2 | 301_1 | TAaatccataaaAA |
| 302 | ctaaatccataaaa | 12329 | 12342 | 2-10-2 | 302_1 | CTaaatccataaAA |
| 303 | actaaatccataaa | 12330 | 12343 | 2-10-2 | 303_1 | ACtaaatccataAA |
| 304 | cactaaatccataa | 12331 | 12344 | 2-10-2 | 304_1 | CActaaatccatAA |
| 305 | tcactaaatccata | 12332 | 12345 | 2-10-2 | 305_1 | TCactaaatccaTA |
| 306 | atcactaaatccat | 12333 | 12346 | 2-10-2 | 306_1 | ATcactaaatccAT |
| 307 | tatcactaaatcca | 12334 | 12347 | 2-10-2 | 307_1 | TAtcactaaatcCA |
| 308 | atatcactaaatcc | 12335 | 12348 | 2-10-2 | 308_1 | ATatcactaaatCC |
| 309 | tatatcactaaatc | 12336 | 12349 | 2-10-2 | 309_1 | TAtatcactaaaTC |

TABLE 2-continued

Sequence Motifs and Compounds of
Exemplary Compounds of the Invention

| SEQ ID NO | motif sequence | start | end | design | CMP ID NO | Oligonucleotide compound |
|---|---|---|---|---|---|---|
| 310 | atatatcactaaat | 12337 | 12350 | 2-10-2 | 310_1 | ATatatcactaaAT |
| 311 | gatatatcactaaa | 12338 | 12351 | 2-10-2 | 311_1 | GAtatatcactaAA |
| 312 | agatatatcactaa | 12339 | 12352 | 2-10-2 | 312_1 | AGatatatcactAA |
| 313 | tagatatatcacta | 12340 | 12353 | 2-10-2 | 313_1 | TAgatatatcacTA |
| 314 | tataaatttctcta | 12690 | 12703 | 2-10-2 | 314_1 | TAtaaatttctcTA |
| 315 | ataaaatttctct | 12691 | 12704 | 2-10-2 | 315_1 | ATataaatttctCT |
| 316 | tatataaatttctc | 12692 | 12705 | 2-10-2 | 316_1 | TAtataaatttcTC |
| 317 | atatataaatttct | 12693 | 12706 | 2-10-2 | 317_1 | ATatataaatttCT |
| 318 | catatataaattc | 12694 | 12707 | 2-10-2 | 318_1 | CAtatataaattTC |
| 319 | tcatatataaattt | 12695 | 12708 | 2-10-2 | 319_1 | TCatatataaatTT |
| 320 | ctccattccaaatt | 12739 | 12752 | 2-10-2 | 320_1 | CTccattccaaaTT |
| 321 | actccattccaaat | 12740 | 12753 | 2-10-2 | 321_1 | ACtccattccaaAT |
| 322 | cactccattccaaa | 12741 | 12754 | 2-10-2 | 322_1 | CActccattccaAA |
| 323 | ccactccattccaa | 12742 | 12755 | 2-10-2 | 323_1 | CCactccattccAA |
| 324 | accactccattcca | 12743 | 12756 | 2-10-2 | 324_1 | ACcactccattcCA |
| 325 | aaccactccattcc | 12744 | 12757 | 2-10-2 | 325_1 | AAccactccattCC |
| 326 | aaaccactccattc | 12745 | 12758 | 2-10-2 | 326_1 | AAaccactccatTC |
| 327 | tcacacaaccatat | 13155 | 13168 | 2-10-2 | 327_1 | TCacacaaccatAT |
| 328 | atcacacaaccata | 13156 | 13169 | 2-10-2 | 328_1 | ATcacacaaccaTA |
| 329 | gatcacacaaccat | 13157 | 13170 | 2-10-2 | 329_1 | GAtcacacaaccAT |
| 330 | agatcacacaacca | 13158 | 13171 | 2-10-2 | 330_1 | AGatcacacaacCA |
| 331 | aagatcacacaacc | 13159 | 13172 | 2-10-2 | 331_1 | AAgatcacacaaCC |
| 332 | aaagatcacacaac | 13160 | 13173 | 2-10-2 | 332_1 | AAagatcacacaAC |
| 333 | aaaagatcacacaa | 13161 | 13174 | 2-10-2 | 333_1 | AAaagatcacacAA |
| 334 | taaaagatcacaca | 13162 | 13175 | 2-10-2 | 334_1 | TAaaagatcacaCA |
| 335 | ttcatttctaaaaa | 13297 | 13310 | 2-10-2 | 335_1 | TTcatttctaaaAA |
| 336 | tttcatttctaaaa | 13298 | 13311 | 2-10-2 | 336_1 | TTtcatttctaaAA |
| 337 | ctttcatttctaaa | 13299 | 13312 | 2-10-2 | 337_1 | CTttcatttctaAA |
| 338 | tctttcatttctaa | 13300 | 13313 | 2-10-2 | 338_1 | TCtttcatttctAA |
| 339 | atctttcatttcta | 13301 | 13314 | 2-10-2 | 339_1 | ATctttcatttcTA |
| 340 | gatctttcatttct | 13302 | 13315 | 2-10-2 | 340_1 | GAtctttcatttCT |
| 341 | tgatctttcatttc | 13303 | 13316 | 2-10-2 | 341_1 | TGatctttcattTC |
| 342 | atgatctttcattt | 13304 | 13317 | 2-10-2 | 342_1 | ATgatctttcatTT |
| 343 | ataaaaacccactt | 13990 | 14003 | 2-10-2 | 343_1 | ATaaaaacccacTT |
| 344 | cataaaaacccact | 13991 | 14004 | 2-10-2 | 344_1 | CAtaaaaacccaCT |
| 345 | acataaaaacccac | 13992 | 14005 | 2-10-2 | 345_1 | ACataaaaacccAC |
| 346 | cacataaaaaccca | 13993 | 14006 | 2-10-2 | 346_1 | CAcataaaaaccCA |

TABLE 2-continued

Sequence Motifs and Compounds of
Exemplary Compounds of the Invention

| SEQ ID NO | motif sequence | start | end | design | CMP ID NO | Oligonucleotide compound |
|---|---|---|---|---|---|---|
| 347 | tcacataaaaaccc | 13994 | 14007 | 2-10-2 | 347_1 | TCacataaaaacCC |
| 348 | atcacataaaaacc | 13995 | 14008 | 2-10-2 | 348_1 | ATcacataaaaCC |
| 349 | catcacataaaaac | 13996 | 14009 | 2-10-2 | 349_1 | CAtcacataaaAC |
| 350 | tcatcacataaaaa | 13997 | 14010 | 2-10-2 | 350_1 | TCatcacataaAA |
| 351 | gtcatcacataaaa | 13998 | 14011 | 2-10-2 | 351_1 | GTcatcacataaAA |
| 352 | agtcatcacataaa | 13999 | 14012 | 2-10-2 | 352_1 | AGtcatcacataAA |
| 353 | tagtcatcacataa | 14000 | 14013 | 2-10-2 | 353_1 | TAgtcatcacatAA |
| 354 | atagtcatcacata | 14001 | 14014 | 2-10-2 | 354_1 | ATagtcatcacaTA |
| 355 | catagtcatcacat | 14002 | 14015 | 2-10-2 | 355_1 | CAtagtcatcacAT |
| 356 | taaatacaaatcta | 14041 | 14054 | 2-10-2 | 356_1 | TAaatacaaatcTA |
| 357 | ctaaatacaaatct | 14042 | 14055 | 2-10-2 | 357_1 | CTaaatacaaatCT |
| 358 | gctaaatacaaatc | 14043 | 14056 | 2-10-2 | 358_1 | GCtaaatacaaaTC |
| 359 | tgctaaatacaaat | 14044 | 14057 | 2-10-2 | 359_1 | TGctaaatacaaAT |
| 360 | atgctaaatacaaa | 14045 | 14058 | 2-10-2 | 360_1 | ATgctaaatacaAA |
| 361 | tatgctaaataCaa | 14046 | 14059 | 2-10-2 | 361_1 | TAtgctaaatacAA |
| 362 | aatcttacactaaa | 14119 | 14132 | 2-10-2 | 362_1 | AAtcttacactaAA |
| 363 | taatcttacactaa | 14120 | 14133 | 2-10-2 | 363_1 | TAatcttacactAA |
| 364 | ataatcttacacta | 14121 | 14134 | 2-10-2 | 364_1 | ATaatcttacacTA |
| 365 | aataatcttacact | 14122 | 14135 | 2-10-2 | 365_1 | AAtaatcttacaCT |
| 366 | gaataatcttacac | 14123 | 14136 | 2-10-2 | 366_1 | GAataatcttacAC |
| 367 | tgaataatcttaca | 14124 | 14137 | 2-10-2 | 367_1 | TGaataatcttaCA |
| 368 | atgaataatcttac | 14125 | 14138 | 2-10-2 | 368_1 | ATgaataatcttAC |
| 369 | caaaattctaataa | 14257 | 14270 | 2-10-2 | 369_1 | CAaaattctaatAA |
| 370 | tcaaaattctaata | 14258 | 14271 | 2-10-2 | 370_1 | TCaaaattctaaTA |
| 371 | ttcaaaattctaat | 14259 | 14272 | 2-10-2 | 371_1 | TTcaaaattctaAT |
| 372 | attcaaaattctaa | 14260 | 14273 | 2-10-2 | 372_1 | ATtcaaaattctAA |
| 373 | gattcaaaattcta | 14261 | 14274 | 2-10-2 | 373_1 | GAttcaaaattcTA |
| 374 | agattcaaaattct | 14262 | 14275 | 2-10-2 | 374_1 | AGattcaaaattCT |
| 375 | attactacaaccaa | 14570 | 14583 | 2-10-2 | 375_1 | ATtactacaaccAA |
| 376 | cattactacaacca | 14571 | 14584 | 2-10-2 | 376_1 | CAttactacaacCA |
| 377 | ccattactacaacc | 14572 | 14585 | 2-10-2 | 377_1 | CCattactacaaCC |
| 378 | accattactacaac | 14573 | 14586 | 2-10-2 | 378_1 | ACcattactacaAC |
| 379 | aaccattactacaa | 14574 | 14587 | 2-10-2 | 379_1 | AAccattactacAA |
| 380 | aaaccattactaca | 14575 | 14588 | 2-10-2 | 380_1 | AAaccattactaCA |
| 381 | gaaaccattactac | 14576 | 14589 | 2-10-2 | 381_1 | GAaaccattactAC |
| 382 | tgaaaccattacta | 14577 | 14590 | 2-10-2 | 382_1 | TGaaaccattacTA |
| 383 | atgaaaccattact | 14578 | 14591 | 2-10-2 | 383_1 | ATgaaaccattaCT |

TABLE 2-continued

Sequence Motifs and Compounds of
Exemplary Compounds of the Invention

| SEQ ID NO | motif sequence | start | end | design | CMP ID NO | Oligonucleotide compound |
|---|---|---|---|---|---|---|
| 384 | atttttaaaaacac | 15778 | 15791 | 2-10-2 | 384_1 | ATttttaaaaacAC |
| 385 | aatttttaaaaaca | 15779 | 15792 | 2-10-2 | 385_1 | AAtttttaaaaaCA |
| 386 | taatttttaaaaac | 15780 | 15793 | 2-10-2 | 386_1 | TAatttttaaaaAC |
| 387 | ataatttttaaaaa | 15781 | 15794 | 2-10-2 | 387_1 | ATaatttttaaaAA |
| 388 | cataatttttaaaa | 15782 | 15795 | 2-10-2 | 388_1 | CAtaatttttaaAA |
| 389 | tcataatttttaaa | 15783 | 15796 | 2-10-2 | 389_1 | TCataatttttaAA |
| 390 | atcataatttttaa | 15784 | 15797 | 2-10-2 | 390_1 | ATcataattttAA |
| 391 | ctttatacaaaaaa | 15814 | 15827 | 2-10-2 | 391_1 | CTttatacaaaaAA |
| 392 | actttatacaaaaa | 15815 | 15828 | 2-10-2 | 392_1 | ACtttatacaaaAA |
| 393 | tactttatacaaaa | 15816 | 15829 | 2-10-2 | 393_1 | TActttatacaaAA |
| 394 | ttactttatacaaa | 15817 | 15830 | 2-10-2 | 394_1 | TTactttatacaAA |
| 395 | cttactttatacaa | 15818 | 15831 | 2-10-2 | 395_1 | CTtactttatacAA |
| 396 | gcttactttataca | 15819 | 15832 | 2-10-2 | 396_1 | GCttactttataCA |
| 397 | tgcttactttatac | 15820 | 15833 | 2-10-2 | 397_1 | TGcttactttatAC |
| 398 | tctcaaaataataa | 15877 | 15890 | 2-10-2 | 398_1 | TCtcaaaataatAA |
| 399 | ctctcaaaataata | 15878 | 15891 | 2-10-2 | 399_1 | CTctcaaaataaTA |
| 400 | tctctcaaaataat | 15879 | 15892 | 2-10-2 | 400_1 | TCtctcaaaataAT |
| 401 | atctctcaaaataa | 15880 | 15893 | 2-10-2 | 401_1 | ATctctcaaaatAA |
| 402 | aatctctcaaaata | 15881 | 15894 | 2-10-2 | 402_1 | AAtctctcaaaaTA |
| 403 | aaatctctcaaaat | 15882 | 15895 | 2-10-2 | 403_1 | AAatctctcaaaAT |
| 404 | taaatctctcaaaa | 15883 | 15896 | 2-10-2 | 404_1 | TAaatctctcaaAA |
| 405 | ttaaatctctcaaa | 15884 | 15897 | 2-10-2 | 405_1 | TTaaatctctcaAA |
| 406 | tttaaatctctcaa | 15885 | 15898 | 2-10-2 | 406_1 | TTtaaatctctcAA |
| 407 | ttttaaatctctca | 15886 | 15899 | 2-10-2 | 407_1 | TTttaaatctctCA |
| 408 | taatacttttcca | 16080 | 16093 | 2-10-2 | 408_1 | TAatacttttcCA |
| 409 | ttaatacttttcc | 16081 | 16094 | 2-10-2 | 409_1 | TTaatacttttCC |
| 410 | gttaatactttttc | 16082 | 16095 | 2-10-2 | 410_1 | GTtaatactttTC |
| 411 | tgttaatactttt | 16083 | 16096 | 2-10-2 | 411_1 | TGttaatacttTT |
| 412 | atgttaatactttt | 16084 | 16097 | 2-10-2 | 412_1 | ATgttaatacttTT |
| 413 | ttatcactaccaca | 16187 | 16200 | 2-10-2 | 413_1 | TTatcactaccaCA |
| 414 | tttatcactaccac | 16188 | 16201 | 2-10-2 | 414_1 | TTtatcactaccAC |
| 415 | atttatcactacca | 16189 | 16202 | 2-10-2 | 415_1 | ATttatcactacCA |
| 416 | catttatcactacc | 16190 | 16203 | 2-10-2 | 416_1 | CAtttatcactaCC |
| 417 | tcatttatcactac | 16191 | 16204 | 2-10-2 | 417_1 | TCatttatcactAC |
| 418 | atcatttatcacta | 16192 | 16205 | 2-10-2 | 418_1 | ATcatttatcacTA |
| 419 | catcatttatcact | 16193 | 16206 | 2-10-2 | 419_1 | CAtcatttatcaCT |
| 420 | acatcatttatcac | 16194 | 16207 | 2-10-2 | 420_1 | ACatcatttatcAC |

TABLE 2-continued

Sequence Motifs and Compounds of
Exemplary Compounds of the Invention

| SEQ ID NO | motif sequence | start | end | design | CMP ID NO | Oligonucleotide compound |
|---|---|---|---|---|---|---|
| 421 | aacatcatttatca | 16195 | 16208 | 2-10-2 | 421_1 | AAcatcatttatCA |
| 422 | taacatcatttatc | 16196 | 16209 | 2-10-2 | 422_1 | TAacatcatttaTC |
| 423 | ttaacatcatttat | 16197 | 16210 | 2-10-2 | 423_1 | TTaacatcatttAT |
| 424 | attaacatcattta | 16198 | 16211 | 2-10-2 | 424_1 | ATtaacatcattTA |
| 425 | aattaacatcattt | 16199 | 16212 | 2-10-2 | 425_1 | AAttaacatcatTT |
| 426 | taattaacatcatt | 16200 | 16213 | 2-10-2 | 426_1 | TAattaacatcaTT |
| 427 | ctaattaacatcat | 16201 | 16214 | 2-10-2 | 427_1 | CTaattaacatcAT |
| 428 | cctaattaacatca | 16202 | 16215 | 2-10-2 | 428_1 | CCtaattaacatCA |
| 429 | ccctaattaacatc | 16203 | 16216 | 2-10-2 | 429_1 | CCctaattaacaTC |
| 430 | gccctaattaacat | 16204 | 16217 | 2-10-2 | 430_1 | GCcctaattaacAT |
| 431 | ggccctaattaaca | 16205 | 16218 | 2-10-2 | 431_1 | GGccctaattaaCA |
| 432 | cggccctaattaac | 16206 | 16219 | 2-10-2 | 432_1 | CGgccctaattaAC |
| 433 | aaacacatttttt | 16494 | 16507 | 2-10-2 | 433_1 | AAacacattttTT |
| 434 | taaacacatttttt | 16495 | 16508 | 2-10-2 | 434_1 | TAaacacattttTT |
| 435 | ataaacacattttt | 16496 | 16509 | 2-10-2 | 435_1 | ATaaacacatttTT |
| 436 | tataaacacatttt | 16497 | 16510 | 2-10-2 | 436_1 | TAtaaacacattTT |
| 437 | atataaacacattt | 16498 | 16511 | 2-10-2 | 437_1 | ATataaacacatTT |
| 438 | catataaacacatt | 16499 | 16512 | 2-10-2 | 438_1 | CAtataaacacaTT |
| 439 | acatataaacacat | 16500 | 16513 | 2-10-2 | 439_1 | ACatataaacacAT |
| 440 | aacatataaacaca | 16501 | 16514 | 2-10-2 | 440_1 | AAcatataaacaCA |
| 441 | taacatataaacac | 16502 | 16515 | 2-10-2 | 441_1 | TAacatataaacAC |
| 442 | ataacatataaaca | 16503 | 16516 | 2-10-2 | 442_1 | ATaacatataaaCA |
| 443 | tataacatataaac | 16504 | 16517 | 2-10-2 | 443_1 | TAtaacatataaAC |
| 444 | atataacatataaa | 16505 | 16518 | 2-10-2 | 444_1 | ATataacatataAA |
| 445 | catataacatataa | 16506 | 16519 | 2-10-2 | 445_1 | CAtataacatatAA |
| 446 | acatataacatata | 16507 | 16520 | 2-10-2 | 446_1 | ACatataacataTA |
| 447 | cacatataacatat | 16508 | 16521 | 2-10-2 | 447_1 | CAcatataacatAT |
| 448 | tcacatataacata | 16509 | 16522 | 2-10-2 | 448_1 | TCacatataacaTA |
| 449 | atcacatataacat | 16510 | 16523 | 2-10-2 | 449_1 | ATcacatataacAT |
| 450 | tatcacatataaca | 16511 | 16524 | 2-10-2 | 450_1 | TAtcacatataaCA |
| 451 | ctatcacatataac | 16512 | 16525 | 2-10-2 | 451_1 | CTatcacatataAC |
| 452 | actatcacatataa | 16513 | 16526 | 2-10-2 | 452_1 | ACtatcacatatAA |
| 453 | cactatcacatata | 16514 | 16527 | 2-10-2 | 453_1 | CActatcacataTA |
| 454 | gtccaacataactc | 16834 | 16847 | 2-10-2 | 454_1 | GTccaacataacTC |
| 455 | agtccaacataact | 16835 | 16848 | 2-10-2 | 455_1 | AGtccaacataaCT |
| 456 | cagtccaacataac | 16836 | 16849 | 2-10-2 | 456_1 | CAgtccaacataAC |
| 457 | tcagtccaacataa | 16837 | 16850 | 2-10-2 | 457_1 | TCagtccaacatAA |

TABLE 2-continued

Sequence Motifs and Compounds of
Exemplary Compounds of the Invention

| SEQ ID NO | motif sequence | start | end | design | CMP ID NO | Oligonucleotide compound |
|---|---|---|---|---|---|---|
| 458 | atcagtccaacata | 16838 | 16851 | 2-10-2 | 458_1 | ATcagtccaacaTA |
| 459 | tatcagtccaacat | 16839 | 16852 | 2-10-2 | 459_1 | TAtcagtccaacAT |
| 460 | aaaccctcccaaaa | 16921 | 16934 | 2-10-2 | 460_1 | AAaccctcccaaAA |
| 461 | taaaccctcccaaa | 16922 | 16935 | 2-10-2 | 461_1 | TAaaccctcccaAA |
| 462 | ttaaaccctcccaa | 16923 | 16936 | 2-10-2 | 462_1 | TTaaaccctcccAA |
| 463 | attaaaccctccca | 16924 | 16937 | 2-10-2 | 463_1 | ATtaaaccctccCA |
| 464 | cattaaaccctccc | 16925 | 16938 | 2-10-2 | 464_1 | CAttaaaccctcCC |
| 465 | acattaaaccctcc | 16926 | 16939 | 2-10-2 | 465_1 | ACattaaaccctCC |
| 466 | aacattaaaccctc | 16927 | 16940 | 2-10-2 | 466_1 | AAcattaaacccTC |
| 467 | aaacattaaaccct | 16928 | 16941 | 2-10-2 | 467_1 | AAacattaaaccCT |
| 468 | taaacattaaaccc | 16929 | 16942 | 2-10-2 | 468_1 | TAaacattaaacCC |
| 469 | ataaacattaaacc | 16930 | 16943 | 2-10-2 | 469_1 | ATaaacattaaaCC |
| 470 | tataaacattaaac | 16931 | 16944 | 2-10-2 | 470_1 | TAtaaacattaaAC |
| 471 | ctataaacattaaa | 16932 | 16945 | 2-10-2 | 471_1 | CTataaacattaAA |
| 472 | actataaacattaa | 16933 | 16946 | 2-10-2 | 472_1 | ACtataaacattAA |
| 473 | aactataaacatta | 16934 | 16947 | 2-10-2 | 473_1 | AActataaacatTA |
| 474 | aaactataaacatt | 16935 | 16948 | 2-10-2 | 474_1 | AAactataaacaTT |
| 475 | taaactataaacat | 16936 | 16949 | 2-10-2 | 475_1 | TAaactataaacAT |
| 476 | ttaaactataaaca | 16937 | 16950 | 2-10-2 | 476_1 | TTaaactataaaCA |
| 477 | tttaaactataaac | 16938 | 16951 | 2-10-2 | 477_1 | TTtaaactataaAC |
| 478 | ctttaaactataaa | 16939 | 16952 | 2-10-2 | 478_1 | CTttaaactataAA |
| 479 | gctttaaactataa | 16940 | 16953 | 2-10-2 | 479_1 | GCtttaaactatAA |
| 480 | tgctttaaactata | 16941 | 16954 | 2-10-2 | 480_1 | TGctttaaactaTA |
| 481 | cagcctatcaccac | 18018 | 18031 | 2-10-2 | 481_1 | CAgcctatcaccAC |
| 482 | acagcctatcacca | 18019 | 18032 | 2-10-2 | 482_1 | ACagcctatcacCA |
| 483 | cacagcctatcacc | 18020 | 18033 | 2-10-2 | 483_1 | CAcagcctatcaCC |
| 484 | tcacagcctatcac | 18021 | 18034 | 2-10-2 | 484_1 | TCacagcctatcAC |
| 485 | atcacagcctatca | 18022 | 18035 | 2-10-2 | 485_1 | ATcacagcctatCA |
| 486 | aatcacagcctatc | 18023 | 18036 | 2-10-2 | 486_1 | AAtcacagcctaTC |
| 487 | aaatcacagcctat | 18024 | 18037 | 2-10-2 | 487_1 | AAatcacagcctAT |
| 488 | caaatcacagccta | 18025 | 18038 | 2-10-2 | 488_1 | CAaatcacagccTA |
| 489 | ccaaatcacagcct | 18026 | 18039 | 2-10-2 | 489_1 | CCaaatcacagcCT |
| 490 | cccaaatcacagcc | 18027 | 18040 | 2-10-2 | 490_1 | CCcaaatcacagCC |
| 491 | acccaaatcacagc | 18028 | 18041 | 2-10-2 | 491_1 | ACccaaatcacaGC |
| 492 | cacccaaatcacag | 18029 | 18042 | 2-10-2 | 492_1 | CAcccaaatcacAG |
| 493 | tcacccaaatcaca | 18030 | 18043 | 2-10-2 | 493_1 | TCacccaaatcaCA |
| 494 | gtcacccaaatcac | 18031 | 18044 | 2-10-2 | 494_1 | GTcacccaaatcAC |

TABLE 2-continued

Sequence Motifs and Compounds of
Exemplary Compounds of the Invention

| SEQ ID NO | motif sequence | start | end | design | CMP ID NO | Oligonucleotide compound |
|---|---|---|---|---|---|---|
| 495 | cgtcacccaaatca | 18032 | 18045 | 2-10-2 | 495_1 | CGtcacccaaatCA |
| 496 | gcgtcacccaaatc | 18033 | 18046 | 2-10-2 | 496_1 | GCgtcacccaaaTC |
| 497 | agcgtcacccaaat | 18034 | 18047 | 2-10-2 | 497_1 | AGcgtcacccaaAT |
| 498 | atcctaaaatcact | 18630 | 18643 | 2-10-2 | 498_1 | ATcctaaaatcaCT |
| 499 | gatcctaaaatcac | 18631 | 18644 | 2-10-2 | 499_1 | GAtcctaaaatcAC |
| 500 | agatcctaaaatca | 18632 | 18645 | 2-10-2 | 500_1 | AGatcctaaaatCA |
| 501 | cagatcctaaaatc | 18633 | 18646 | 2-10-2 | 501_1 | CAgatcctaaaaTC |
| 502 | tcagatcctaaaat | 18634 | 18647 | 2-10-2 | 502_1 | TCagatcctaaaAT |
| 503 | aaaccaatcatcat | 19107 | 19120 | 2-10-2 | 503_1 | AAaccaatcatcAT |
| 504 | aaaaccaatcatca | 19108 | 19121 | 2-10-2 | 504_1 | AAaaccaatcatCA |
| 505 | taaaaccaatcatc | 19109 | 19122 | 2-10-2 | 505_1 | TAaaaccaatcaTC |
| 506 | gtaaaaccaatcat | 19110 | 19123 | 2-10-2 | 506_1 | GTaaaaccaatcAT |
| 507 | agtaaaaccaatca | 19111 | 19124 | 2-10-2 | 507_1 | AGtaaaaccaatCA |
| 508 | aagtaaaaccaatc | 19112 | 19125 | 2-10-2 | 508_1 | AAgtaaaaccaaTC |
| 509 | aaagtaaaaccaat | 19113 | 19126 | 2-10-2 | 509_1 | AAagtaaaaccaAT |
| 510 | catctctactaaaa | 20214 | 20227 | 2-10-2 | 510_1 | CAtctctactaaAA |
| 511 | ccatctctactaaa | 20215 | 20228 | 2-10-2 | 511_1 | CCatctctactaAA |
| 512 | tccatctctactaa | 20216 | 20229 | 2-10-2 | 512_1 | TCcatctctactAA |
| 513 | ttccatctctacta | 20217 | 20230 | 2-10-2 | 513_1 | TTccatctctacTA |
| 514 | cttccatctctact | 20218 | 20231 | 2-10-2 | 514_1 | CTtccatctctaCT |
| 515 | ccttccatctctac | 20219 | 20232 | 2-10-2 | 515_1 | CCttccatctctAC |
| 516 | cccttccatctcta | 20220 | 20233 | 2-10-2 | 516_1 | CCcttccatctcTA |
| 517 | acataacaaaccca | 20555 | 20568 | 2-10-2 | 517_1 | ACataacaaaccCA |
| 518 | tacataacaaaccc | 20556 | 20569 | 2-10-2 | 518_1 | TAcataacaaaCC |
| 519 | ctacataacaaacc | 20557 | 20570 | 2-10-2 | 519_1 | CTacataacaaaCC |
| 520 | actacataacaaac | 20558 | 20571 | 2-10-2 | 520_1 | ACtacataacaaAC |
| 521 | aactacataacaaa | 20559 | 20572 | 2-10-2 | 521_1 | AActacataacaAA |
| 522 | taactacataacaa | 20560 | 20573 | 2-10-2 | 522_1 | TAactacataacAA |
| 523 | ataactacataaca | 20561 | 20574 | 2-10-2 | 523_1 | ATaactacataaCA |
| 524 | aataactacataac | 20562 | 20575 | 2-10-2 | 524_1 | AAtaactacataAC |
| 525 | caataactacataa | 20563 | 20576 | 2-10-2 | 525_1 | CAataactacatAA |
| 526 | acaataactacata | 20564 | 20577 | 2-10-2 | 526_1 | ACaataactacaTA |
| 527 | cacaataactacat | 20565 | 20578 | 2-10-2 | 527_1 | CAcaataactacAT |
| 528 | tcacaataactaca | 20566 | 20579 | 2-10-2 | 528_1 | TCacaataactaCA |
| 529 | ttcacaataactac | 20567 | 20580 | 2-10-2 | 529_1 | TTcacaataactAC |
| 530 | attcacaataacta | 20568 | 20581 | 2-10-2 | 530_1 | ATtcacaataacTA |
| 531 | aattcacaataact | 20569 | 20582 | 2-10-2 | 531_1 | AAttcacaataaCT |

TABLE 2-continued

Sequence Motifs and Compounds of
Exemplary Compounds of the Invention

| SEQ ID NO | motif sequence | start | end | design | CMP ID NO | Oligonucleotide compound |
|---|---|---|---|---|---|---|
| 532 | gaattcacaataac | 20570 | 20583 | 2-10-2 | 532_1 | GAattcacaataAC |
| 533 | tgaattcacaataa | 20571 | 20584 | 2-10-2 | 533_1 | TGaattcacaatAA |
| 534 | ctaaaacaatctaa | 22073 | 22086 | 2-10-2 | 534_1 | CTaaaacaatctAA |
| 535 | cctaaaacaatcta | 22074 | 22087 | 2-10-2 | 535_1 | CCtaaaacaatcTA |
| 536 | acctaaaacaatct | 22075 | 22088 | 2-10-2 | 536_1 | ACctaaaacaatCT |
| 537 | tacctaaaacaatc | 22076 | 22089 | 2-10-2 | 537_1 | TAcctaaaacaaTC |
| 538 | atacctaaaacaat | 22077 | 22090 | 2-10-2 | 538_1 | ATacctaaaacaAT |
| 539 | tatacctaaaacaa | 22078 | 22091 | 2-10-2 | 539_1 | TAtacctaaaacAA |
| 540 | ctatacctaaaaca | 22079 | 22092 | 2-10-2 | 540_1 | CTatacctaaaaCA |
| 541 | gctatacctaaaac | 22080 | 22093 | 2-10-2 | 541_1 | GCtatacctaaaAC |
| 542 | ttgtaactaaaaat | 22254 | 22267 | 2-10-2 | 542_1 | TTgtaactaaaaAT |
| 543 | cttgtaactaaaaa | 22255 | 22268 | 2-10-2 | 543_1 | CTtgtaactaaaAA |
| 544 | ccttgtaactaaaa | 22256 | 22269 | 2-10-2 | 544_1 | CCttgtaactaaAA |
| 545 | cccttgtaactaaa | 22257 | 22270 | 2-10-2 | 545_1 | CCcttgtaactaAA |
| 546 | cccettgtaactaa | 22258 | 22271 | 2-10-2 | 546_1 | CCccttgtaactAA |
| 547 | acccettgtaacta | 22259 | 22272 | 2-10-2 | 547_1 | ACcccttgtaacTA |
| 548 | cacccettgtaact | 22260 | 22273 | 2-10-2 | 548_1 | CAccccttgtaaCT |
| 549 | acacccettgtaac | 22261 | 22274 | 2-10-2 | 549_1 | ACaccccttgtaAC |
| 550 | ttcatatatacatc | 22424 | 22437 | 2-10-2 | 550_1 | TTcatatatacaTC |
| 551 | cttcatatatacat | 22425 | 22438 | 2-10-2 | 551_1 | CTtcatatatacAT |
| 552 | ccttcatatataca | 22426 | 22439 | 2-10-2 | 552_1 | CCttcatatataCA |
| 553 | cccttcatatatac | 22427 | 22440 | 2-10-2 | 553_1 | CCcttcatatatAC |
| 554 | acccttcatatata | 22428 | 22441 | 2-10-2 | 554_1 | ACccttcatataTA |
| 555 | taccettcatatat | 22429 | 22442 | 2-10-2 | 555_1 | TAccettcatatAT |
| 556 | ttacccttcatata | 22430 | 22443 | 2-10-2 | 556_1 | TTaccettcataTA |
| 557 | attacccttcatat | 22431 | 22444 | 2-10-2 | 557_1 | ATtaccettcatAT |
| 558 | cattacccttcata | 22432 | 22445 | 2-10-2 | 558_1 | CAttaccettcaTA |
| 559 | acattacccttcat | 22433 | 22446 | 2-10-2 | 559_1 | ACattaccettcAT |
| 560 | tacattacccttca | 22434 | 22447 | 2-10-2 | 560_1 | TAcattaccettCA |
| 561 | tcttatacttacta | 23204 | 23217 | 2-10-2 | 561_1 | TCttatacttacTA |
| 562 | ttcttatacttact | 23205 | 23218 | 2-10-2 | 562_1 | TTcttatacttaCT |
| 563 | attcttatacttac | 23206 | 23219 | 2-10-2 | 563_1 | ATtcttatacttAC |
| 564 | gattcttatactta | 23207 | 23220 | 2-10-2 | 564_1 | GAttcttatactTA |
| 565 | tgattcttatactt | 23208 | 23221 | 2-10-2 | 565_1 | TGattcttatacTT |
| 566 | atgattcttatact | 23209 | 23222 | 2-10-2 | 566_1 | ATgattcttataCT |
| 567 | aacttcactaaaat | 23616 | 23629 | 2-10-2 | 567_1 | AActtcactaaaAT |
| 568 | aaacttcactaaaa | 23617 | 23630 | 2-10-2 | 568_1 | AAacttcactaaAA |

TABLE 2-continued

Sequence Motifs and Compounds of
Exemplary Compounds of the Invention

| SEQ ID NO | motif sequence | start | end | design | CMP ID NO | Oligonucleotide compound |
|---|---|---|---|---|---|---|
| 569 | taaacttcactaaa | 23618 | 23631 | 2-10-2 | 569_1 | TAaacttcactaAA |
| 570 | ataaacttcactaa | 23619 | 23632 | 2-10-2 | 570_1 | ATaaacttcactAA |
| 571 | aataaacttcacta | 23620 | 23633 | 2-10-2 | 571_1 | AAtaaacttcacTA |
| 572 | taataaacttcact | 23621 | 23634 | 2-10-2 | 572_1 | TAataaacttcaCT |
| 573 | ctaataaacttcac | 23622 | 23635 | 2-10-2 | 573_1 | CTaataaacttcAC |
| 574 | actaataaacttca | 23623 | 23636 | 2-10-2 | 574_1 | ACtaataaacttCA |
| 575 | aactaataaacttc | 23624 | 23637 | 2-10-2 | 575_1 | AActaataaactTC |
| 576 | aatcttctattta | 24108 | 24121 | 2-10-2 | 576_1 | AAtcttctattTA |
| 577 | caatcttctatttt | 24109 | 24122 | 2-10-2 | 577_1 | CAatcttctattTT |
| 578 | ccaatcttctattt | 24110 | 24123 | 2-10-2 | 578_1 | CCaatcttctatTT |
| 579 | accaatcttctatt | 24111 | 24124 | 2-10-2 | 579_1 | ACcaatcttctaTT |
| 580 | aaccaatcttctat | 24112 | 24125 | 2-10-2 | 580_1 | AAccaatcttctAT |
| 581 | caaccaatcttcta | 24113 | 24126 | 2-10-2 | 581_1 | CAaccaatcttcTA |
| 582 | gcaaccaatcttct | 24114 | 24127 | 2-10-2 | 582_1 | GCaaccaatcttCT |
| 583 | tgcaaccaatcttc | 24115 | 24128 | 2-10-2 | 583_1 | TGcaaccaatctTC |
| 584 | ctgcaaccaatctt | 24116 | 24129 | 2-10-2 | 584_1 | CTgcaaccaatcTT |
| 585 | actgcaaccaatct | 24117 | 24130 | 2-10-2 | 585_1 | ACtgcaaccaatCT |
| 586 | aactgcaaccaatc | 24118 | 24131 | 2-10-2 | 586_1 | AActgcaaccaaTC |
| 587 | taactgcaaccaat | 24119 | 24132 | 2-10-2 | 587_1 | TAactgcaaccaAT |
| 588 | tacaacacacatca | 24335 | 24348 | 2-10-2 | 588_1 | TAcaacacacatCA |
| 589 | atacaacacacatc | 24336 | 24349 | 2-10-2 | 589_1 | ATacaacacacaTC |
| 590 | aatacaacacacat | 24337 | 24350 | 2-10-2 | 590_1 | AAtacaacacacAT |
| 591 | gaatacaacacaca | 24338 | 24351 | 2-10-2 | 591_1 | GAatacaacacaCA |
| 592 | tgaatacaacacac | 24339 | 24352 | 2-10-2 | 592_1 | TGaatacaacacAC |
| 593 | atgaatacaacaca | 24340 | 24353 | 2-10-2 | 593_1 | ATgaatacaacaCA |
| 594 | cctaataaaatata | 24499 | 24512 | 2-10-2 | 594_1 | CCtaataaaataTA |
| 595 | tcctaataaaatat | 24500 | 24513 | 2-10-2 | 595_1 | TCctaataaaatAT |
| 596 | ctcctaataaaata | 24501 | 24514 | 2-10-2 | 596_1 | CTcctaataaaaTA |
| 597 | actcctaataaaat | 24502 | 24515 | 2-10-2 | 597_1 | ACtcctaataaaAT |
| 598 | tactcctaataaaa | 24503 | 24516 | 2-10-2 | 598_1 | TActcctaataaAA |
| 599 | ctactcctaataaa | 24504 | 24517 | 2-10-2 | 599_1 | CTactcctaataAA |
| 600 | actactcctaataa | 24505 | 24518 | 2-10-2 | 600_1 | ACtactcctaatAA |
| 601 | aactactcctaata | 24506 | 24519 | 2-10-2 | 601_1 | AActactcctaaTA |
| 602 | taactactcctaat | 24507 | 24520 | 2-10-2 | 602_1 | TAactactcctaAT |
| 603 | ataactactcctaa | 24508 | 24521 | 2-10-2 | 603_1 | ATaactactcctAA |
| 604 | tataactactccta | 24509 | 24522 | 2-10-2 | 604_1 | TAtaactactccTA |
| 605 | ataactactcct | 24510 | 24523 | 2-10-2 | 605_1 | ATataactactcCT |

TABLE 2-continued

Sequence Motifs and Compounds of
Exemplary Compounds of the Invention

| SEQ ID NO | motif sequence | start | end | design | CMP ID NO | Oligonucleotide compound |
|---|---|---|---|---|---|---|
| 606 | aatataactactcc | 24511 | 24524 | 2-10-2 | 606_1 | AAtataactactCC |
| 607 | aaatataactactc | 24512 | 24525 | 2-10-2 | 607_1 | AAatataactacTC |
| 608 | aaaatataactact | 24513 | 24526 | 2-10-2 | 608_1 | AAaatataactaCT |
| 609 | aaaaatataactac | 24514 | 24527 | 2-10-2 | 609_1 | AAaaatataactAC |
| 610 | taaaaatataacta | 24515 | 24528 | 2-10-2 | 610_1 | TAaaaatataacTA |
| 611 | gtaaaaatataact | 24516 | 24529 | 2-10-2 | 611_1 | GTaaaaatataaCT |
| 612 | agtaaaaatataac | 24517 | 24530 | 2-10-2 | 612_1 | AGtaaaaatataAC |
| 613 | actgatacccacaa | 24593 | 24606 | 2-10-2 | 613_1 | ACtgatacccacAA |
| 614 | aactgatacccaca | 24594 | 24607 | 2-10-2 | 614_1 | AActgatacccaCA |
| 615 | caactgatacccac | 24595 | 24608 | 2-10-2 | 615_1 | CAactgatacccAC |
| 616 | tcaactgataccca | 24596 | 24609 | 2-10-2 | 616_1 | TCaactgataccCA |
| 617 | atcactaaaaaact | 24752 | 24765 | 2-10-2 | 617_1 | ATcactaaaaaaCT |
| 618 | tatcactaaaaaac | 24753 | 24766 | 2-10-2 | 618_1 | TAtcactaaaaaAC |
| 619 | atatcactaaaaaa | 24754 | 24767 | 2-10-2 | 619_1 | ATatcactaaaaAA |
| 620 | tatatcactaaaaa | 24755 | 24768 | 2-10-2 | 620_1 | TAtatcactaaaAA |
| 621 | ttatatcactaaaa | 24756 | 24769 | 2-10-2 | 621_1 | TTatatcactaaAA |
| 622 | tttatatcactaaa | 24757 | 24770 | 2-10-2 | 622_1 | TTtatatcactaAA |
| 623 | gtttatatcactaa | 24758 | 24771 | 2-10-2 | 623_1 | GTttatatcactAA |
| 624 | aaactttttaattaa | 24850 | 24863 | 2-10-2 | 624_1 | AAacttttaattAA |
| 625 | caaacttttaatta | 24851 | 24864 | 2-10-2 | 625_1 | CAaactttttaatTA |
| 626 | tcaaacttttaatt | 24852 | 24865 | 2-10-2 | 626_1 | TCaaacttttaaTT |
| 627 | ttcaaacttttaat | 24853 | 24866 | 2-10-2 | 627_1 | TTcaaactttttaAT |
| 628 | cttcaaacttttaa | 24854 | 24867 | 2-10-2 | 628_1 | CTtcaaacttttAA |
| 629 | acttcaaactttta | 24855 | 24868 | 2-10-2 | 629_1 | ACttcaaacttttTA |
| 630 | cacttcaaactttt | 24856 | 24869 | 2-10-2 | 630_1 | CActtcaaacttTT |
| 631 | ccacttcaaacttt | 24857 | 24870 | 2-10-2 | 631_1 | CCacttcaaactTT |
| 632 | cccacttcaaactt | 24858 | 24871 | 2-10-2 | 632_1 | CCcacttcaaacTT |
| 633 | acccacttcaaact | 24859 | 24872 | 2-10-2 | 633_1 | ACccacttcaaaCT |
| 634 | aacccacttcaaac | 24860 | 24873 | 2-10-2 | 634_1 | AAcccacttcaaAC |
| 635 | aaacccacttcaaa | 24861 | 24874 | 2-10-2 | 635_1 | AAacccacttcaAA |
| 636 | aaaacccacttcaa | 24862 | 24875 | 2-10-2 | 636_1 | AAaacccacttcAA |
| 637 | aaaaacccacttca | 24863 | 24876 | 2-10-2 | 637_1 | AAaaacccacttCA |
| 638 | aaaaaacccacttc | 24864 | 24877 | 2-10-2 | 638_1 | AAaaaacccactTC |
| 639 | caaaaaacccactt | 24865 | 24878 | 2-10-2 | 639_1 | CAaaaaacccacTT |
| 640 | acaaaaaacccact | 24866 | 24879 | 2-10-2 | 640_1 | ACaaaaaacccaCT |
| 641 | aacaaaaaacccac | 24867 | 24880 | 2-10-2 | 641_1 | AAcaaaaaacccAC |
| 642 | aaacaaaaaaccca | 24868 | 24881 | 2-10-2 | 642_1 | AAacaaaaaaccCA |

TABLE 2-continued

Sequence Motifs and Compounds of
Exemplary Compounds of the Invention

| SEQ ID NO | motif sequence | start | end | design | CMP ID NO | Oligonucleotide compound |
|---|---|---|---|---|---|---|
| 643 | aaaacaaaaaaccc | 24869 | 24882 | 2-10-2 | 643_1 | AAaacaaaaaacCC |
| 644 | atcttcccattaat | 24976 | 24989 | 2-10-2 | 644_1 | ATcttcccattaAT |
| 645 | aatcttcccattaa | 24977 | 24990 | 2-10-2 | 645_1 | AAtcttcccattAA |
| 646 | taatcttcccatta | 24978 | 24991 | 2-10-2 | 646_1 | TAatcttcccatTA |
| 647 | ataatcttcccatt | 24979 | 24992 | 2-10-2 | 647_1 | ATaatcttcccaTT |
| 648 | aataatcttcccat | 24980 | 24993 | 2-10-2 | 648_1 | AAtaatcttcccAT |
| 649 | aaataatcttccca | 24981 | 24994 | 2-10-2 | 649_1 | AAataatcttccCA |
| 650 | aaaataatcttccc | 24982 | 24995 | 2-10-2 | 650_1 | AAaataatcttcCC |
| 651 | tattaatcaaaaat | 25057 | 25070 | 2-10-2 | 651_1 | TAttaatcaaaaAT |
| 652 | ctattaatcaaaaa | 25058 | 25071 | 2-10-2 | 652_1 | CTattaatcaaaAA |
| 653 | tctattaatcaaaa | 25059 | 25072 | 2-10-2 | 653_1 | TCtattaatcaaAA |
| 654 | ctctattaatcaaa | 25060 | 25073 | 2-10-2 | 654_1 | CTctattaatcaAA |
| 655 | actctattaatcaa | 25061 | 25074 | 2-10-2 | 655_1 | ACtctattaatcAA |
| 656 | gactctattaatca | 25062 | 25075 | 2-10-2 | 656_1 | GActctattaatCA |
| 657 | tattctactcttct | 25433 | 25446 | 2-10-2 | 657_1 | TAttctactcttCT |
| 658 | atattctactcttc | 25434 | 25447 | 2-10-2 | 658_1 | ATattctactctTC |
| 659 | aatattctactctt | 25435 | 25448 | 2-10-2 | 659_1 | AAtattctactcTT |
| 660 | gaatattctactct | 25436 | 25449 | 2-10-2 | 660_1 | GAatattctactCT |
| 661 | agaatattctactc | 25437 | 25450 | 2-10-2 | 661_1 | AGaatattctacTC |
| 662 | atttaccaattcaa | 25508 | 25521 | 2-10-2 | 662_1 | ATttaccaattcAA |
| 663 | tatttaccaattca | 25509 | 25522 | 2-10-2 | 663_1 | TAtttaccaattCA |
| 664 | gtatttaccaattc | 25510 | 25523 | 2-10-2 | 664_1 | GTatttaccaatTC |
| 665 | tgtatttaccaatt | 25511 | 25524 | 2-10-2 | 665_1 | TGtatttaccaaTT |
| 666 | ctgtatttaccaat | 25512 | 25525 | 2-10-2 | 666_1 | CTgtatttaccaAT |
| 667 | actgtatttaccaa | 25513 | 25526 | 2-10-2 | 667_1 | ACtgtatttaccAA |
| 668 | ttataccatcaaat | 27100 | 27113 | 2-10-2 | 668_1 | TTataccatcaaAT |
| 669 | attataccatcaaa | 27101 | 27114 | 2-10-2 | 669_1 | ATtataccatcaAA |
| 670 | cattataccatcaa | 27102 | 27115 | 2-10-2 | 670_1 | CAttataccatcAA |
| 671 | tcattataccatca | 27103 | 27116 | 2-10-2 | 671_1 | TCattataccatCA |
| 672 | ttcattataccatc | 27104 | 27117 | 2-10-2 | 672_1 | TTcattataccaTC |
| 673 | cttcattataccat | 27105 | 27118 | 2-10-2 | 673_1 | CTtcattataccAT |
| 674 | tcttcattatacca | 27106 | 27119 | 2-10-2 | 674_1 | TCttcattataccCA |
| 675 | ttcttcattatacc | 27107 | 27120 | 2-10-2 | 675_1 | TTcttcattataCC |
| 676 | tttcttcattatac | 27108 | 27121 | 2-10-2 | 676_1 | TTtcttcattatAC |
| 677 | ttttcttcattata | 27109 | 27122 | 2-10-2 | 677_1 | TTttcttcattaTA |
| 678 | attttcttcattat | 27110 | 27123 | 2-10-2 | 678_1 | ATtttcttcattAT |
| 679 | tattttcttcatta | 27111 | 27124 | 2-10-2 | 679_1 | TAttttcttcatTA |

TABLE 2-continued

Sequence Motifs and Compounds of
Exemplary Compounds of the Invention

| SEQ ID NO | motif sequence | start | end | design | CMP ID NO | Oligonucleotide compound |
|---|---|---|---|---|---|---|
| 680 | atattttcttcatt | 27112 | 27125 | 2-10-2 | 680_1 | ATattttcttcaTT |
| 681 | aatattttcttcat | 27113 | 27126 | 2-10-2 | 681_1 | AAtattttcttcAT |
| 682 | aaatattttcttca | 27114 | 27127 | 2-10-2 | 682_1 | AAatattttcttCA |
| 683 | taaatattttcttc | 27115 | 27128 | 2-10-2 | 683_1 | TAaatattttctTC |
| 684 | aataatccaaactt | 27772 | 27785 | 2-10-2 | 684_1 | AAtaatccaaacTT |
| 685 | aaataatccaaact | 27773 | 27786 | 2-10-2 | 685_1 | AAataatccaaaCT |
| 686 | aaaataatccaaac | 27774 | 27787 | 2-10-2 | 686_1 | AAaataatccaaAC |
| 687 | caaaataatccaaa | 27775 | 27788 | 2-10-2 | 687_1 | CAaaataatccAA |
| 688 | acaaaataatccaa | 27776 | 27789 | 2-10-2 | 688_1 | ACaaaataatccAA |
| 689 | tacaaaataatcca | 27777 | 27790 | 2-10-2 | 689_1 | TAcaaaataatcCA |
| 690 | ttacaaaataatcc | 27778 | 27791 | 2-10-2 | 690_1 | TTacaaaataatCC |
| 691 | gttacaaaataatc | 27779 | 27792 | 2-10-2 | 691_1 | GTtacaaaataaTC |
| 692 | tgttacaaaataat | 27780 | 27793 | 2-10-2 | 692_1 | TGttacaaaataAT |
| 693 | ttttacattaacta | 27935 | 27948 | 2-10-2 | 693_1 | TTttacattaacTA |
| 694 | tttttacattaact | 27936 | 27949 | 2-10-2 | 694_1 | TTtttacattaaCT |
| 695 | ttttttacattaac | 27937 | 27950 | 2-10-2 | 695_1 | TTttttacattaAC |
| 696 | attttttacattaa | 27938 | 27951 | 2-10-2 | 696_1 | ATttttacattAA |
| 697 | tattttttacatta | 27939 | 27952 | 2-10-2 | 697_1 | TAttttttacatTA |
| 698 | ttattttttacatt | 27940 | 27953 | 2-10-2 | 698_1 | TTattttttacaTT |
| 699 | aaatactaacatca | 29299 | 29312 | 2-10-2 | 699_1 | AAatactaacatCA |
| 700 | aaaatactaacatc | 29300 | 29313 | 2-10-2 | 700_1 | AAaatactaacaTC |
| 701 | caaaatactaacat | 29301 | 29314 | 2-10-2 | 701_1 | CAaaatactaacAT |
| 702 | ccaaaatactaaca | 29302 | 29315 | 2-10-2 | 702_1 | CCaaaatactaaCA |
| 703 | gccaaaatactaac | 29303 | 29316 | 2-10-2 | 703_1 | GCcaaaatactaAC |
| 704 | tgccaaaatactaa | 29304 | 29317 | 2-10-2 | 704_1 | TGccaaaatactAA |
| 705 | tccattcattttat | 29415 | 29428 | 2-10-2 | 705_1 | TCcattcattttAT |
| 706 | atccattcatttta | 29416 | 29429 | 2-10-2 | 706_1 | ATccattcattTA |
| 707 | catccattcatttt | 29417 | 29430 | 2-10-2 | 707_1 | CAtccattcattTT |
| 708 | acatccattcattt | 29418 | 29431 | 2-10-2 | 708_1 | ACatccattcatTT |
| 709 | cacatccattcatt | 29419 | 29432 | 2-10-2 | 709_1 | CAcatccattcaTT |
| 710 | ccacatccattcat | 29420 | 29433 | 2-10-2 | 710_1 | CCacatccattcAT |
| 711 | gccacatccattca | 29421 | 29434 | 2-10-2 | 711_1 | GCcacatccattCA |
| 712 | tgccacatccattc | 29422 | 29435 | 2-10-2 | 712_1 | TGccacatccatTC |
| 713 | atgccacatccatt | 29423 | 29436 | 2-10-2 | 713_1 | ATgccacatccaTT |
| 714 | tatgccacatccat | 29424 | 29437 | 2-10-2 | 714_1 | TAtgccacatccAT |
| 715 | ttatgccacatcca | 29425 | 29438 | 2-10-2 | 715_1 | TTatgccacatcCA |
| 716 | attatgccacatcc | 29426 | 29439 | 2-10-2 | 716_1 | ATtatgccacatCC |

TABLE 2-continued

Sequence Motifs and Compounds of
Exemplary Compounds of the Invention

| SEQ ID NO | motif sequence | start | end | design | CMP ID NO | Oligonucleotide compound |
|---|---|---|---|---|---|---|
| 717 | tcttaactcttctc | 30753 | 30766 | 2-10-2 | 717_1 | TCttaactcttcTC |
| 718 | ttcttaactcttct | 30754 | 30767 | 2-10-2 | 718_1 | TTcttaactcttCT |
| 719 | gttcttaactcttc | 30755 | 30768 | 2-10-2 | 719_1 | GTtcttaactctTC |
| 720 | agttcttaactctt | 30756 | 30769 | 2-10-2 | 720_1 | AGttcttaactcTT |
| 721 | tagttcttaactct | 30757 | 30770 | 2-10-2 | 721_1 | TAgttcttaactCT |
| 722 | caaatactcaaaaa | 31029 | 31042 | 2-10-2 | 722_1 | CAaatactcaaaAA |
| 723 | tcaaatactcaaaa | 31030 | 31043 | 2-10-2 | 723_1 | TCaaatactcaaAA |
| 724 | ttcaaatactcaaa | 31031 | 31044 | 2-10-2 | 724_1 | TTcaaatactcAAA |
| 725 | cttcaaatactcaa | 31032 | 31045 | 2-10-2 | 725_1 | CTtcaaatactcAA |
| 726 | gcttcaaatactca | 31033 | 31046 | 2-10-2 | 726_1 | GCttcaaatactCA |
| 727 | agcttcaaatactc | 31034 | 31047 | 2-10-2 | 727_1 | AGcttcaaatacTC |
| 728 | aagcttcaaatact | 31035 | 31048 | 2-10-2 | 728_1 | AAgcttcaaataCT |
| 729 | cctcattacccatt | 32059 | 32072 | 2-10-2 | 729_1 | CCtcattacccaTT |
| 730 | tcctcattacccat | 32060 | 32073 | 2-10-2 | 730_1 | TCctcattacccAT |
| 731 | atcctcattaccca | 32061 | 32074 | 2-10-2 | 731_1 | ATcctcattaccCA |
| 732 | tatcctcattaccc | 32062 | 32075 | 2-10-2 | 732_1 | TAtcctcattacCC |
| 733 | atatcctcattacc | 32063 | 32076 | 2-10-2 | 733_1 | ATatcctcattaCC |
| 734 | aatatcctcattac | 32064 | 32077 | 2-10-2 | 734_1 | AAtatcctcattAC |
| 735 | taatatcctcatta | 32065 | 32078 | 2-10-2 | 735_1 | TAatatcctcatTA |
| 736 | ttaatatcctcatt | 32066 | 32079 | 2-10-2 | 736_1 | TTaatatcctcaTT |
| 737 | tttaatatcctcat | 32067 | 32080 | 2-10-2 | 737_1 | TTtaatatcctcAT |
| 738 | atttaatatcctca | 32068 | 32081 | 2-10-2 | 738_1 | ATttaatatcctCA |
| 739 | aatttaatatcctc | 32069 | 32082 | 2-10-2 | 739_1 | AAtttaatatccTC |
| 740 | aaatttaatatcct | 32070 | 32083 | 2-10-2 | 740_1 | AAatttaatatcCT |
| 741 | taaatttaatatcc | 32071 | 32084 | 2-10-2 | 741_1 | TAaatttaatatCC |
| 742 | ttaaatttaatatc | 32072 | 32085 | 2-10-2 | 742_1 | TTaaatttaataTC |
| 743 | cttaaatttaatat | 32073 | 32086 | 2-10-2 | 743_1 | CTtaaatttaatAT |
| 744 | tcttaaatttaata | 32074 | 32087 | 2-10-2 | 744_1 | TCttaaatttaaTA |
| 745 | ttcttaaatttaat | 32075 | 32088 | 2-10-2 | 745_1 | TTcttaaatttaAT |
| 746 | gttcttaaatttaa | 32076 | 32089 | 2-10-2 | 746_1 | GTtcttaaatttAA |
| 747 | ttattctacttta | 33431 | 33444 | 2-10-2 | 747_1 | TTattctactttTA |
| 748 | tttattctactttt | 33432 | 33445 | 2-10-2 | 748_1 | TTtattctactttTT |
| 749 | ctttattctacttt | 33433 | 33446 | 2-10-2 | 749_1 | CTttattctactTT |
| 750 | cctttattctactt | 33434 | 33447 | 2-10-2 | 750_1 | CCtttattctacTT |
| 751 | gcctttattctact | 33435 | 33448 | 2-10-2 | 751_1 | GCctttattctaCT |
| 752 | aacaattattaata | 33797 | 33810 | 2-10-2 | 752_1 | AAcaattattaaTA |
| 753 | caacaattattaat | 33798 | 33811 | 2-10-2 | 753_1 | CAacaattattaAT |

TABLE 2-continued

Sequence Motifs and Compounds of
Exemplary Compounds of the Invention

| SEQ ID NO | motif sequence | start | end | design | CMP ID NO | Oligonucleotide compound |
|---|---|---|---|---|---|---|
| 754 | gcaacaattattaa | 33799 | 33812 | 2-10-2 | 754_1 | GCaacaattattAA |
| 755 | agcaacaattatta | 33800 | 33813 | 2-10-2 | 755_1 | AGcaacaattatTA |
| 756 | cagcaacaattatt | 33801 | 33814 | 2-10-2 | 756_1 | CAgcaacaattaTT |
| 757 | ccagcaacaattat | 33802 | 33815 | 2-10-2 | 757_1 | CCagcaacaattAT |
| 758 | accagcaacaatta | 33803 | 33816 | 2-10-2 | 758_1 | ACcagcaacaatTA |
| 759 | aaaccaaaacttac | 33963 | 33976 | 2-10-2 | 759_1 | AAaccaaaacttAC |
| 760 | aaaaccaaaactta | 33964 | 33977 | 2-10-2 | 760_1 | AAaaccaaaactTA |
| 761 | aaaaaccaaaactt | 33965 | 33978 | 2-10-2 | 761_1 | AAaaaccaaaacTT |
| 762 | caaaaaccaaaact | 33966 | 33979 | 2-10-2 | 762_1 | CAaaaaccaaaaCT |
| 763 | ccaaaaaccaaaac | 33967 | 33980 | 2-10-2 | 763_1 | CCaaaaaccaaaAC |
| 764 | accaaaaaccaaaa | 33968 | 33981 | 2-10-2 | 764_1 | ACcaaaaaccaaAA |
| 765 | aaccaaaaaccaaa | 33969 | 33982 | 2-10-2 | 765_1 | AAccaaaaaccaAA |
| 766 | aaaccaaaaaccaa | 33970 | 33983 | 2-10-2 | 766_1 | AAaccaaaaaccAA |
| 767 | atctaaaacacttc | 34050 | 34063 | 2-10-2 | 767_1 | ATctaaaacactTC |
| 768 | aatctaaaacactt | 34051 | 34064 | 2-10-2 | 768_1 | AAtctaaaacacTT |
| 769 | aaatctaaaacact | 34052 | 34065 | 2-10-2 | 769_1 | AAatctaaaacaCT |
| 770 | caaatctaaaacac | 34053 | 34066 | 2-10-2 | 770_1 | CAaatctaaaacAC |
| 771 | ccaaatctaaaaca | 34054 | 34067 | 2-10-2 | 771_1 | CCaaatctaaaaCA |
| 772 | cccaaatctaaaac | 34055 | 34068 | 2-10-2 | 772_1 | CCcaaatctaaaAC |
| 773 | ccccaaatctaaaa | 34056 | 34069 | 2-10-2 | 773_1 | CCccaaatctaaAA |
| 774 | accccaaatctaaa | 34057 | 34070 | 2-10-2 | 774_1 | ACcccaaatctaAA |
| 775 | aaccccaaatctaa | 34058 | 34071 | 2-10-2 | 775_1 | AAccccaaatctAA |
| 776 | aaaccccaaatcta | 34059 | 34072 | 2-10-2 | 776_1 | AAaccccaaatcTA |
| 777 | attcacaaatccta | 34075 | 34088 | 2-10-2 | 777_1 | ATtcacaaatccTA |
| 778 | tattcacaaatcct | 34076 | 34089 | 2-10-2 | 778_1 | TAttcacaaatcCT |
| 779 | atattcacaaatcc | 34077 | 34090 | 2-10-2 | 779_1 | ATattcacaaatCC |
| 780 | aatattcacaaatc | 34078 | 34091 | 2-10-2 | 780_1 | AAtattcacaaaTC |
| 781 | aaatattcacaaat | 34079 | 34092 | 2-10-2 | 781_1 | AAatattcacaaAT |
| 782 | caaatattcacaaa | 34080 | 34093 | 2-10-2 | 782_1 | CAaatattcacaAA |
| 783 | gcaaatattcacaa | 34081 | 34094 | 2-10-2 | 783_1 | GCaaatattcacAA |
| 784 | aacacacattatca | 34537 | 34550 | 2-10-2 | 784_1 | AAcacacattatCA |
| 785 | taacacacattatc | 34538 | 34551 | 2-10-2 | 785_1 | TAacacacattaTC |
| 786 | ttaacacacattat | 34539 | 34552 | 2-10-2 | 786_1 | TTaacacacattAT |
| 787 | tttaacacacatta | 34540 | 34553 | 2-10-2 | 787_1 | TTtaacacacatTA |
| 788 | atttaacacacatt | 34541 | 34554 | 2-10-2 | 788_1 | ATttaacacacaTT |
| 789 | tatttaacacacat | 34542 | 34555 | 2-10-2 | 789_1 | TAtttaacacacAT |
| 790 | ctatttaacacaca | 34543 | 34556 | 2-10-2 | 790_1 | CTatttaacacaCA |

TABLE 2-continued

Sequence Motifs and Compounds of
Exemplary Compounds of the Invention

| SEQ ID NO | motif sequence | start | end | design | CMP ID NO | Oligonucleotide compound |
|---|---|---|---|---|---|---|
| 791 | actatttaacacac | 34544 | 34557 | 2-10-2 | 791_1 | ACtatttaacacAC |
| 792 | tactatttaacaca | 34545 | 34558 | 2-10-2 | 792_1 | TActatttaacCA |
| 793 | ctactatttaacac | 34546 | 34559 | 2-10-2 | 793_1 | CTactatttaacAC |
| 794 | actactatttaaca | 34547 | 34560 | 2-10-2 | 794_1 | ACtactatttaaCA |
| 795 | aactactatttaac | 34548 | 34561 | 2-10-2 | 795_1 | AActactatttaAC |
| 796 | aaactactatttaa | 34549 | 34562 | 2-10-2 | 796_1 | AAactactatttAA |
| 797 | aaaactactattta | 34550 | 34563 | 2-10-2 | 797_1 | AAactactattTA |
| 798 | gaaaactactattt | 34551 | 34564 | 2-10-2 | 798_1 | GAaaactactatTT |
| 799 | tgaaaactactatt | 34552 | 34565 | 2-10-2 | 799_1 | TGaaaactactaTT |
| 800 | aaataacctatcat | 35309 | 35322 | 2-10-2 | 800_1 | AAataacctatcAT |
| 801 | aaaataacctatca | 35310 | 35323 | 2-10-2 | 801_1 | AAaataacctatCA |
| 802 | caaaataacctatc | 35311 | 35324 | 2-10-2 | 802_1 | CAaaataacctaTC |
| 803 | acaaaataacctat | 35312 | 35325 | 2-10-2 | 803_1 | ACaaaataacctAT |
| 804 | cacaaaataaccta | 35313 | 35326 | 2-10-2 | 804_1 | CAcaaaataaccTA |
| 805 | tcacaaaataacct | 35314 | 35327 | 2-10-2 | 805_1 | TCacaaaataacCT |
| 806 | atcacaaaataacc | 35315 | 35328 | 2-10-2 | 806_1 | ATcacaaaataaCC |
| 807 | catcacaaaataac | 35316 | 35329 | 2-10-2 | 807_1 | CAtcacaaaataAC |
| 808 | tcatcacaaaataa | 35317 | 35330 | 2-10-2 | 808_1 | TCatcacaaaatAA |
| 809 | ttcatcacaaaata | 35318 | 35331 | 2-10-2 | 809_1 | TTcatcacaaaaTA |
| 810 | tttcatcacaaaat | 35319 | 35332 | 2-10-2 | 810_1 | TTtcatcacaaaAT |
| 811 | ttttcatcacaaaa | 35320 | 35333 | 2-10-2 | 811_1 | TTttcatcacaaAA |
| 812 | attttcatcacaaa | 35321 | 35334 | 2-10-2 | 812_1 | ATtttcatcacaAA |
| 813 | tattttcatcacaa | 35322 | 35335 | 2-10-2 | 813_1 | TAttttcatcacAA |
| 814 | gtattttcatcaca | 35323 | 35336 | 2-10-2 | 814_1 | GTattttcatcaCA |
| 815 | atttaaatttatca | 35354 | 35367 | 2-10-2 | 815_1 | ATttaaatttatCA |
| 816 | aatttaaatttatc | 35355 | 35368 | 2-10-2 | 816_1 | AAtttaaatttaTC |
| 817 | aaatttaaatttat | 35356 | 35369 | 2-10-2 | 817_1 | AAatttaaatttAT |
| 818 | aaaatttaaattta | 35357 | 35370 | 2-10-2 | 818_1 | AAaatttaaattTA |
| 819 | taaaatttaaattt | 35358 | 35371 | 2-10-2 | 819_1 | TAaaatttaaatTT |
| 820 | ataaaatttaaatt | 35359 | 35372 | 2-10-2 | 820_1 | ATaaaatttaaaTT |
| 821 | cataaaatttaaat | 35360 | 35373 | 2-10-2 | 821_1 | CAtaaaatttaaAT |
| 822 | acataaaatttaaa | 35361 | 35374 | 2-10-2 | 822_1 | ACataaaatttaAA |
| 823 | ctactaatattcat | 36332 | 36345 | 2-10-2 | 823_1 | CTactaatattcAT |
| 824 | cctactaatattca | 36333 | 36346 | 2-10-2 | 824_1 | CCtactaatattCA |
| 825 | acctactaatattc | 36334 | 36347 | 2-10-2 | 825_1 | ACctactaatatTC |
| 826 | cacctactaatatt | 36335 | 36348 | 2-10-2 | 826_1 | CAcctactaataTT |
| 827 | tcacctactaatat | 36336 | 36349 | 2-10-2 | 827_1 | TCacctactaatAT |

TABLE 2-continued

Sequence Motifs and Compounds of
Exemplary Compounds of the Invention

| SEQ ID NO | motif sequence | start | end | design | CMP ID NO | Oligonucleotide compound |
|---|---|---|---|---|---|---|
| 828 | ttcacctactaata | 36337 | 36350 | 2-10-2 | 828_1 | TTcacctactaaTA |
| 829 | tttcacctactaat | 36338 | 36351 | 2-10-2 | 829_1 | TTtcacctactaAT |
| 830 | ttttcacctactaa | 36339 | 36352 | 2-10-2 | 830_1 | TTttcacctactAA |
| 831 | tttttcacctacta | 36340 | 36353 | 2-10-2 | 831_1 | TTtttcacctacTA |
| 832 | atttttcacctact | 36341 | 36354 | 2-10-2 | 832_1 | ATtttttcacctaCT |
| 833 | tatttttcacctac | 36342 | 36355 | 2-10-2 | 833_1 | TAtttttcacctAC |
| 834 | ttatttttcaccta | 36343 | 36356 | 2-10-2 | 834_1 | TTatttttcaccTA |
| 835 | tttatttttcacct | 36344 | 36357 | 2-10-2 | 835_1 | TTtatttttcacCT |
| 836 | ttctactactaatt | 36468 | 36481 | 2-10-2 | 836_1 | TTctactactaaTT |
| 837 | cttctactactaat | 36469 | 36482 | 2-10-2 | 837_1 | CTtctactactaAT |
| 838 | acttctactactaa | 36470 | 36483 | 2-10-2 | 838_1 | ACttctactactAA |
| 839 | aacttctactacta | 36471 | 36484 | 2-10-2 | 839_1 | AActtctactacTA |
| 840 | caacttctactact | 36472 | 36485 | 2-10-2 | 840_1 | CAacttctactaCT |
| 841 | tcaacttctactac | 36473 | 36486 | 2-10-2 | 841_1 | TCaacttctactAC |
| 842 | ctcaacttctacta | 36474 | 36487 | 2-10-2 | 842_1 | CTcaacttctacTA |
| 843 | tctcaacttctact | 36475 | 36488 | 2-10-2 | 843_1 | TCtcaacttctaCT |
| 844 | ctctcaacttctac | 36476 | 36489 | 2-10-2 | 844_1 | CTctcaacttctAC |
| 845 | tctctcaacttcta | 36477 | 36490 | 2-10-2 | 845_1 | TCtctcaacttcTA |
| 846 | ttctctcaacttct | 36478 | 36491 | 2-10-2 | 846_1 | TTctctcaacttCT |
| 847 | tttctctcaacttc | 36479 | 36492 | 2-10-2 | 847_1 | TTtctctcaactTC |
| 848 | ttttctctcaactt | 36480 | 36493 | 2-10-2 | 848_1 | TTttctctcaacTT |
| 849 | tttttctctcaact | 36481 | 36494 | 2-10-2 | 849_1 | TTtttctctcaaCT |
| 850 | ctttttctctcaac | 36482 | 36495 | 2-10-2 | 850_1 | CTttttctctcaAC |
| 851 | actttttctctcaa | 36483 | 36496 | 2-10-2 | 851_1 | ACtttttctctcAA |
| 852 | tactttttctctca | 36484 | 36497 | 2-10-2 | 852_1 | TActttttctctCA |
| 853 | ttactttttctctc | 36485 | 36498 | 2-10-2 | 853_1 | TTactttttctcTC |
| 854 | gttactttttctct | 36486 | 36499 | 2-10-2 | 854_1 | GTtactttttctCT |
| 855 | agttactttttctc | 36487 | 36500 | 2-10-2 | 855_1 | AGttactttttcTC |
| 856 | cattcccattaaca | 36788 | 36801 | 2-10-2 | 856_1 | CAttcccattaaCA |
| 857 | acattcccattaac | 36789 | 36802 | 2-10-2 | 857_1 | ACattcccattaAC |
| 858 | tacattcccattaa | 36790 | 36803 | 2-10-2 | 858_1 | TAcattcccattAA |
| 859 | ttacattcccatta | 36791 | 36804 | 2-10-2 | 859_1 | TTacattcccatTA |
| 860 | tttacattcccatt | 36792 | 36805 | 2-10-2 | 860_1 | TTtacattcccaTT |
| 861 | ttttacattcccat | 36793 | 36806 | 2-10-2 | 861_1 | TTttacattcccAT |
| 862 | cttttacattccca | 36794 | 36807 | 2-10-2 | 862_1 | CTtttacattccCA |
| 863 | acttttacattccc | 36795 | 36808 | 2-10-2 | 863_1 | ACttttacattcCC |
| 864 | cacttttacattcc | 36796 | 36809 | 2-10-2 | 864_1 | CActtttacattCC |

TABLE 2-continued

Sequence Motifs and Compounds of
Exemplary Compounds of the Invention

| SEQ ID NO | motif sequence | start | end | design | CMP ID NO | Oligonucleotide compound |
|---|---|---|---|---|---|---|
| 865 | acactttacattc | 36797 | 36810 | 2-10-2 | 865_1 | ACactttacatTC |
| 866 | tacactttacatt | 36798 | 36811 | 2-10-2 | 866_1 | TAcactttacaTT |
| 867 | gtacactttacat | 36799 | 36812 | 2-10-2 | 867_1 | GTacactttacAT |
| 868 | tgtacactttaca | 36800 | 36813 | 2-10-2 | 868_1 | TGtacactttaCA |
| 869 | tttatcaaaaaat | 36834 | 36847 | 2-10-2 | 869_1 | TTtatcaaaaaAT |
| 870 | atttatcaaaaaa | 36835 | 36848 | 2-10-2 | 870_1 | ATttatcaaaaAA |
| 871 | catttatcaaaaa | 36836 | 36849 | 2-10-2 | 871_1 | CAtttatcaaaAA |
| 872 | acatttatcaaaa | 36837 | 36850 | 2-10-2 | 872_1 | ACatttatcaaAA |
| 873 | tacatttatcaaa | 36838 | 36851 | 2-10-2 | 873_1 | TAcatttatcaAA |
| 874 | atacatttatcaa | 36839 | 36852 | 2-10-2 | 874_1 | ATacatttatcAA |
| 875 | tatacatttatcaa | 36840 | 36853 | 2-10-2 | 875_1 | TAtacatttatcAA |
| 876 | acatcttccaattt | 38848 | 38861 | 2-10-2 | 876_1 | ACatcttccaatTT |
| 877 | tacatcttccaatt | 38849 | 38862 | 2-10-2 | 877_1 | TAcatcttccaaTT |
| 878 | ttacatcttccaat | 38850 | 38863 | 2-10-2 | 878_1 | TTacatcttccaAT |
| 879 | tttacatcttccaa | 38851 | 38864 | 2-10-2 | 879_1 | TTtacatcttccAA |
| 880 | atttacatcttcca | 38852 | 38865 | 2-10-2 | 880_1 | ATttacatcttcCA |
| 881 | tatttacatcttcc | 38853 | 38866 | 2-10-2 | 881_1 | TAtttacatcttCC |
| 882 | ttatttacatcttc | 38854 | 38867 | 2-10-2 | 882_1 | TTatttacatctTC |
| 883 | cttatttacatctt | 38855 | 38868 | 2-10-2 | 883_1 | CTtatttacatcTT |
| 884 | tcttatttacatct | 38856 | 38869 | 2-10-2 | 884_1 | TCttatttacatCT |
| 885 | atcttatttacatc | 38857 | 38870 | 2-10-2 | 885_1 | ATcttatttacaTC |
| 886 | aatcttatttacat | 38858 | 38871 | 2-10-2 | 886_1 | AAtcttatttacAT |
| 887 | gaatcttatttaca | 38859 | 38872 | 2-10-2 | 887_1 | GAatcttatttaCA |
| 888 | tgaatcttatttac | 38860 | 38873 | 2-10-2 | 888_1 | TGaatcttatttAC |
| 889 | ttcccttcactcct | 40071 | 40084 | 2-10-2 | 889_1 | TTcccttcactcCT |
| 890 | tttcccttcactcc | 40072 | 40085 | 2-10-2 | 890_1 | TTtcccttcactCC |
| 891 | ttttcccttcactc | 40073 | 40086 | 2-10-2 | 891_1 | TTttcccttcacTC |
| 892 | attttcccttcact | 40074 | 40087 | 2-10-2 | 892_1 | ATtttcccttcaCT |
| 893 | aattttcccttcac | 40075 | 40088 | 2-10-2 | 893_1 | AAttttcccttcAC |
| 894 | taattttcccttca | 40076 | 40089 | 2-10-2 | 894_1 | TAattttcccttCA |
| 895 | ttaattttcccttc | 40077 | 40090 | 2-10-2 | 895_1 | TTaattttcccTC |
| 896 | gttaattttccctt | 40078 | 40091 | 2-10-2 | 896_1 | GTtaattttcccTT |
| 897 | tttatcatttcttt | 40150 | 40163 | 2-10-2 | 897_1 | TTtatcatttctTT |
| 898 | ttttatcatttctt | 40151 | 40164 | 2-10-2 | 898_1 | TTttatcatttcTT |
| 899 | cttttatcatttct | 40152 | 40165 | 2-10-2 | 899_1 | CTtttatcatttCT |
| 900 | tcttttatcatttc | 40153 | 40166 | 2-10-2 | 900_1 | TCttttatcatTC |
| 901 | ttcttttatcattt | 40154 | 40167 | 2-10-2 | 901_1 | TTcttttatcatTT |

TABLE 2-continued

Sequence Motifs and Compounds of
Exemplary Compounds of the Invention

| SEQ ID NO | motif sequence | start | end | design | CMP ID NO | Oligonucleotide compound |
|---|---|---|---|---|---|---|
| 902 | cttcttttatcatt | 40155 | 40168 | 2-10-2 | 902_1 | CTtcttttatcaTT |
| 903 | acttcttttatcat | 40156 | 40169 | 2-10-2 | 903_1 | ACttcttttatcAT |
| 904 | tacttcttttatca | 40157 | 40170 | 2-10-2 | 904_1 | TActtcttttatCA |
| 905 | ttacttcttttatc | 40158 | 40171 | 2-10-2 | 905_1 | TTacttcttttaTC |
| 906 | attacttcttttat | 40159 | 40172 | 2-10-2 | 906_1 | ATtacttcttttAT |
| 907 | aattacttctttta | 40160 | 40173 | 2-10-2 | 907_1 | AAttacttcttTA |
| 908 | aaattacttctttt | 40161 | 40174 | 2-10-2 | 908_1 | AAattacttcttTT |
| 909 | aaaattacttcttt | 40162 | 40175 | 2-10-2 | 909_1 | AAaattacttctTT |
| 910 | caaaattacttctt | 40163 | 40176 | 2-10-2 | 910_1 | CAaaattacttcTT |
| 911 | ccaaaattacttct | 40164 | 40177 | 2-10-2 | 911_1 | CCaaaattacttCT |
| 912 | tccaaaattacttc | 40165 | 40178 | 2-10-2 | 912_1 | TCcaaaattactTC |
| 913 | ttccaaaattactt | 40166 | 40179 | 2-10-2 | 913_1 | TTccaaaattacTT |
| 914 | gttccaaaattact | 40167 | 40180 | 2-10-2 | 914_1 | GTtccaaaattaCT |
| 915 | tgttccaaaattac | 40168 | 40181 | 2-10-2 | 915_1 | TGttccaaaattAC |
| 916 | atgttccaaaatta | 40169 | 40182 | 2-10-2 | 916_1 | ATgttccaaaatTA |
| 917 | ttactcttttatt | 40201 | 40214 | 2-10-2 | 917_1 | TTactcttttaTT |
| 918 | tttactctttttat | 40202 | 40215 | 2-10-2 | 918_1 | TTtactcttttAT |
| 919 | ttttactcttttta | 40203 | 40216 | 2-10-2 | 919_1 | TTttactcttttTA |
| 920 | attttactctttt | 40204 | 40217 | 2-10-2 | 920_1 | ATtttactctttTT |
| 921 | tattttactctttt | 40205 | 40218 | 2-10-2 | 921_1 | TAttttactctTT |
| 922 | atattttactcttt | 40206 | 40219 | 2-10-2 | 922_1 | ATattttactctTT |
| 923 | catattttactctt | 40207 | 40220 | 2-10-2 | 923_1 | CAtattttactcTT |
| 924 | ccatattttactct | 40208 | 40221 | 2-10-2 | 924_1 | CCatattttactCT |
| 925 | cccatattttactc | 40209 | 40222 | 2-10-2 | 925_1 | CCcatattttacTC |
| 926 | acccatattttact | 40210 | 40223 | 2-10-2 | 926_1 | ACccatattttaCT |
| 927 | tacccatatttac | 40211 | 40224 | 2-10-2 | 927_1 | TAcccatattttAC |
| 928 | ttacccatatttta | 40212 | 40225 | 2-10-2 | 928_1 | TTacccatatttTA |
| 929 | tttacccatattt | 40213 | 40226 | 2-10-2 | 929_1 | TTtacccatatTT |
| 930 | gtttacccatattt | 40214 | 40227 | 2-10-2 | 930_1 | GTttacccatatTT |
| 931 | tgtttacccatatt | 40215 | 40228 | 2-10-2 | 931_1 | TGtttacccataTT |
| 932 | gttacctcccttta | 40368 | 40381 | 2-10-2 | 932_1 | GTtacctcccttTA |
| 933 | ggttacctccctt | 40369 | 40382 | 2-10-2 | 933_1 | GGttacctccctTT |
| 934 | aggttacctcccttt | 40370 | 40383 | 2-10-2 | 934_1 | AGgttacctcccTT |
| 935 | caaactaaaaccta | 41659 | 41672 | 2-10-2 | 935_1 | CAaactaaaaccTA |
| 936 | tcaaactaaaacct | 41660 | 41673 | 2-10-2 | 936_1 | TCaaactaaaacCT |
| 937 | atcaaactaaaacc | 41661 | 41674 | 2-10-2 | 937_1 | ATcaaactaaaaCC |
| 938 | gatcaaactaaaac | 41662 | 41675 | 2-10-2 | 938_1 | GAtcaaactaaaAC |

TABLE 2-continued

Sequence Motifs and Compounds of
Exemplary Compounds of the Invention

| SEQ ID NO | motif sequence | start | end | design | CMP ID NO | Oligonucleotide compound |
|---|---|---|---|---|---|---|
| 939 | agatcaaactaaaa | 41663 | 41676 | 2-10-2 | 939_1 | AGatcaaactaaAA |
| 940 | aagatcaaactaaa | 41664 | 41677 | 2-10-2 | 940_1 | AAgatcaaactaAA |
| 941 | ccaatttcacccaa | 41699 | 41712 | 2-10-2 | 941_1 | CCaatttcacccAA |
| 942 | cccaatttcaccca | 41700 | 41713 | 2-10-2 | 942_1 | CCcaatttcaccCA |
| 943 | gcccaatttcaccc | 41701 | 41714 | 2-10-2 | 943_1 | GCccaatttcacCC |
| 944 | tgcccaatttcacc | 41702 | 41715 | 2-10-2 | 944_1 | TGcccaatttcaCC |
| 945 | ttgcccaatttcac | 41703 | 41716 | 2-10-2 | 945_1 | TTgcccaatttcAC |
| 946 | caactttctatttt | 41777 | 41790 | 2-10-2 | 946_1 | CAactttctattTT |
| 947 | ccaactttctattt | 41778 | 41791 | 2-10-2 | 947_1 | CCaactttctatTT |
| 948 | cccaactttctatt | 41779 | 41792 | 2-10-2 | 948_1 | CCcaactttctaTT |
| 949 | acccaactttctat | 41780 | 41793 | 2-10-2 | 949_1 | ACccaactttctAT |
| 950 | aacccaactttcta | 41781 | 41794 | 2-10-2 | 950_1 | AAcccaactttcTA |
| 951 | aaacccaactttct | 41782 | 41795 | 2-10-2 | 951_1 | AAacccaactttCT |
| 952 | aaaacccaactttc | 41783 | 41796 | 2-10-2 | 952_1 | AAaacccaactTTC |
| 953 | aaaaacccaacttt | 41784 | 41797 | 2-10-2 | 953_1 | AAaaacccaactTT |
| 954 | caaaaacccaactt | 41785 | 41798 | 2-10-2 | 954_1 | CAaaaacccaacTT |
| 955 | acaaaaacccaact | 41786 | 41799 | 2-10-2 | 955_1 | ACaaaaacccaaCT |
| 956 | ctttaaaatttcca | 42170 | 42183 | 2-10-2 | 956_1 | CTttaaaatttcCA |
| 957 | tctttaaaatttcc | 42171 | 42184 | 2-10-2 | 957_1 | TCtttaaaatttCC |
| 958 | ttctttaaaatttc | 42172 | 42185 | 2-10-2 | 958_1 | TTctttaaaattTC |
| 959 | tttctttaaaattt | 42173 | 42186 | 2-10-2 | 959_1 | TTtctttaaaatTT |
| 960 | atttctttaaaatt | 42174 | 42187 | 2-10-2 | 960_1 | ATttctttaaaaTT |
| 961 | catttctttaaaat | 42175 | 42188 | 2-10-2 | 961_1 | CAtttctttaaaAT |
| 962 | acatttctttaaaa | 42176 | 42189 | 2-10-2 | 962_1 | ACatttctttaaAA |
| 963 | cacatttctttaaa | 42177 | 42190 | 2-10-2 | 963_1 | CAcatttctttaAA |
| 964 | ccacatttctttaa | 42178 | 42191 | 2-10-2 | 964_1 | CCacatttctttAA |
| 965 | accacatttcttta | 42179 | 42192 | 2-10-2 | 965_1 | ACcacatttctTTA |
| 966 | aaccacatttcttt | 42180 | 42193 | 2-10-2 | 966_1 | AAccacatttctTT |
| 967 | aaaccacatttctt | 42181 | 42194 | 2-10-2 | 967_1 | AAaccacatttcTT |
| 968 | aaaaccacatttct | 42182 | 42195 | 2-10-2 | 968_1 | AAaaccacatttCT |
| 969 | caaaaccacatttc | 42183 | 42196 | 2-10-2 | 969_1 | CAaaaccacattTC |
| 970 | ttcttctcttttca | 43831 | 43844 | 2-10-2 | 970_1 | TTcttctcttttCA |
| 971 | tttcttctctttc | 43832 | 43845 | 2-10-2 | 971_1 | TTtcttctcttTTC |
| 972 | ttttcttctctttt | 43833 | 43846 | 2-10-2 | 972_1 | TTttcttctctTTT |
| 973 | tttttcttctcttt | 43834 | 43847 | 2-10-2 | 973_1 | TTtttcttctctTT |
| 974 | ttttttcttctctt | 43835 | 43848 | 2-10-2 | 974_1 | TTttttcttctcTT |
| 975 | attttttcttctct | 43836 | 43849 | 2-10-2 | 975_1 | ATttttttcttctCT |

TABLE 2-continued

Sequence Motifs and Compounds of
Exemplary Compounds of the Invention

| SEQ ID NO | motif sequence | start | end | design | CMP ID NO | Oligonucleotide compound |
|---|---|---|---|---|---|---|
| 976 | tatttttctcttctc | 43837 | 43850 | 2-10-2 | 976_1 | TAttttttcttcTC |
| 977 | aacttaatattaaa | 45488 | 45501 | 2-10-2 | 977_1 | AActtaatattaAA |
| 978 | caacttaatattaa | 45489 | 45502 | 2-10-2 | 978_1 | CAacttaatattAA |
| 979 | tcaacttaatatta | 45490 | 45503 | 2-10-2 | 979_1 | TCaacttaatatTA |
| 980 | ttcaacttaatatt | 45491 | 45504 | 2-10-2 | 980_1 | TTcaacttaataTT |
| 981 | attcaacttaatat | 45492 | 45505 | 2-10-2 | 981_1 | ATtcaacttaatAT |
| 982 | tattcaacttaata | 45493 | 45506 | 2-10-2 | 982_1 | TAttcaacttaaTA |
| 983 | ttattcaacttaat | 45494 | 45507 | 2-10-2 | 983_1 | TTattcaacttaAT |
| 984 | tttattcaacttaa | 45495 | 45508 | 2-10-2 | 984_1 | TTtattcaacttAA |
| 985 | caaattaaaaaaca | 47397 | 47410 | 2-10-2 | 985_1 | CAaattaaaaaaCA |
| 986 | tcaaattaaaaaac | 47398 | 47411 | 2-10-2 | 986_1 | TCaaattaaaaaAC |
| 987 | ttcaaattaaaaaa | 47399 | 47412 | 2-10-2 | 987_1 | TTcaaattaaaaAA |
| 988 | cttcaaattaaaaa | 47400 | 47413 | 2-10-2 | 988_1 | CTtcaaattaaaAA |
| 989 | tcttcaaattaaaa | 47401 | 47414 | 2-10-2 | 989_1 | TCttcaaattaaAA |
| 990 | ttcttcaaattaaa | 47402 | 47415 | 2-10-2 | 990_1 | TTcttcaaattaAA |
| 991 | tttcttcaaattaa | 47403 | 47416 | 2-10-2 | 991_1 | TTtcttcaaattAA |
| 992 | aacacaaattcaaa | 48077 | 48090 | 2-10-2 | 992_1 | AAcacaaattcaAA |
| 993 | aaacacaaattcaa | 48078 | 48091 | 2-10-2 | 993_1 | AAacacaaattcAA |
| 994 | taaacacaaattca | 48079 | 48092 | 2-10-2 | 994_1 | TAaacacaaattCA |
| 995 | ataaacacaaattc | 48080 | 48093 | 2-10-2 | 995_1 | ATaaacacaaatTC |
| 996 | aataaacacaaatt | 48081 | 48094 | 2-10-2 | 996_1 | AAtaaacacaaaTT |
| 997 | caataaacacaaat | 48082 | 48095 | 2-10-2 | 997_1 | CAataaacacaaAT |
| 998 | acaataaacacaaa | 48083 | 48096 | 2-10-2 | 998_1 | ACaataaacacaAA |
| 999 | aacaataaacacaa | 48084 | 48097 | 2-10-2 | 999_1 | AAcaataaacacAA |
| 1000 | taacaataaacaca | 48085 | 48098 | 2-10-2 | 1000_1 | TAacaataaacaCA |
| 1001 | ttaacaataaacac | 48086 | 48099 | 2-10-2 | 1001_1 | TTaacaataaacAC |
| 1002 | attaacaataaaca | 48087 | 48100 | 2-10-2 | 1002_1 | ATtaacaataaaCA |
| 1003 | aattaacaataaac | 48088 | 48101 | 2-10-2 | 1003_1 | AAttaacaataaAC |
| 1004 | gaattaacaataaa | 48089 | 48102 | 2-10-2 | 1004_1 | GAattaacaataAA |
| 1005 | tgaattaacaataa | 48090 | 48103 | 2-10-2 | 1005_1 | TGaattaacaatAA |
| 1006 | atattcctcaatca | 48905 | 48918 | 2-10-2 | 1006_1 | ATattcctcaatCA |
| 1007 | tatattcctcaatc | 48906 | 48919 | 2-10-2 | 1007_1 | TAtattcctcaaTC |
| 1008 | atatattcctcaat | 48907 | 48920 | 2-10-2 | 1008_1 | ATatattcctcaAT |
| 1009 | aatatattcctcaa | 48908 | 48921 | 2-10-2 | 1009_1 | AAtatattcctcAA |
| 1010 | caatatattcctca | 48909 | 48922 | 2-10-2 | 1010_1 | CAatatattcctCA |
| 1011 | acaatatattcctc | 48910 | 48923 | 2-10-2 | 1011_1 | ACaatatattccTC |
| 1012 | gacaatatattcct | 48911 | 48924 | 2-10-2 | 1012_1 | GAcaatatattcCT |

TABLE 2-continued

Sequence Motifs and Compounds of
Exemplary Compounds of the Invention

| SEQ ID NO | motif sequence | start | end | design | CMP ID NO | Oligonucleotide compound |
|---|---|---|---|---|---|---|
| 1013 | caatcctaattaaa | 48960 | 48973 | 2-10-2 | 1013_1 | CAatcctaattaAA |
| 1014 | ccaatcctaattaa | 48961 | 48974 | 2-10-2 | 1014_1 | CCaatcctaattAA |
| 1015 | cccaatcctaatta | 48962 | 48975 | 2-10-2 | 1015_1 | CCcaatcctaatTA |
| 1016 | gcccaatcctaatt | 48963 | 48976 | 2-10-2 | 1016_1 | GCccaatcctaaTT |
| 1017 | tgcccaatcctaat | 48964 | 48977 | 2-10-2 | 1017_1 | TGcccaatcctaAT |
| 1018 | accctacaaatact | 50093 | 50106 | 2-10-2 | 1018_1 | ACcctacaaataCT |
| 1019 | aaccctacaaatac | 50094 | 50107 | 2-10-2 | 1019_1 | AAcctacaaatAC |
| 1020 | aaaccctacaaata | 50095 | 50108 | 2-10-2 | 1020_1 | AAaccctacaaaTA |
| 1021 | aaaaccctacaaat | 50096 | 50109 | 2-10-2 | 1021_1 | AAaaccctacaaAT |
| 1022 | aaaaaccctacaaa | 50097 | 50110 | 2-10-2 | 1022_1 | AAaaaccctacaAA |
| 1023 | aaaaaaccctacaa | 50098 | 50111 | 2-10-2 | 1023_1 | AAaaaaccctacAA |
| 1024 | aaaaaaaccctaca | 50099 | 50112 | 2-10-2 | 1024_1 | AAaaaaaccctaCA |
| 1025 | tatacactattaat | 51008 | 51021 | 2-10-2 | 1025_1 | TAtacactattaAT |
| 1026 | ttatacactattaa | 51009 | 51022 | 2-10-2 | 1026_1 | TTatacactattAA |
| 1027 | attatacactatta | 51010 | 51023 | 2-10-2 | 1027_1 | ATtatacactatTA |
| 1028 | aattatacactatt | 51011 | 51024 | 2-10-2 | 1028_1 | AAttatacactaTT |
| 1029 | gaattatacactat | 51012 | 51025 | 2-10-2 | 1029_1 | GAattatacactAT |
| 1030 | gtaacaattataca | 51866 | 51879 | 2-10-2 | 1030_1 | GTaacaattataCA |
| 1031 | tgtaacaattatac | 51867 | 51880 | 2-10-2 | 1031_1 | TGtaacaattatAC |
| 1032 | ctgtaacaattata | 51868 | 51881 | 2-10-2 | 1032_1 | CTgtaacaattaTA |
| 1033 | cctgtaacaattat | 51869 | 51882 | 2-10-2 | 1033_1 | CCtgtaacaattAT |
| 1034 | tcctgtaacaatta | 51870 | 51883 | 2-10-2 | 1034_1 | TCctgtaacaatTA |
| 1035 | ataaaaaccacctt | 53263 | 53276 | 2-10-2 | 1035_1 | ATaaaaaccaccTT |
| 1036 | aataaaaaccacct | 53264 | 53277 | 2-10-2 | 1036_1 | AAtaaaaaccacCT |
| 1037 | gaataaaaaccacc | 53265 | 53278 | 2-10-2 | 1037_1 | GAataaaaaccaCC |
| 1038 | agaataaaaaccac | 53266 | 53279 | 2-10-2 | 1038_1 | AGaataaaaaccAC |
| 1039 | cagaataaaaacca | 53267 | 53280 | 2-10-2 | 1039_1 | CAgaataaaaacCA |
| 1040 | ccagaataaaaacc | 53268 | 53281 | 2-10-2 | 1040_1 | CCagaataaaaaCC |
| 1041 | cccagaataaaaac | 53269 | 53282 | 2-10-2 | 1041_1 | CCcagaataaaaAC |
| 1042 | acccagaataaaaa | 53270 | 53283 | 2-10-2 | 1042_1 | ACccagaataaaAA |
| 1043 | tttcttactcccct | 53699 | 53712 | 2-10-2 | 1043_1 | TTtcttactcccCT |
| 1044 | ctttcttactcccc | 53700 | 53713 | 2-10-2 | 1044_1 | CTttcttactccCC |
| 1045 | actttcttactccc | 53701 | 53714 | 2-10-2 | 1045_1 | ACtttcttactcCC |
| 1046 | cactttcttactcc | 53702 | 53715 | 2-10-2 | 1046_1 | CActttcttactCC |
| 1047 | ccactttcttactc | 53703 | 53716 | 2-10-2 | 1047_1 | CCactttcttacTC |
| 1048 | cctttaccactttt | 53948 | 53961 | 2-10-2 | 1048_1 | CCtttaccactTT |
| 1049 | ccctttaccacttt | 53949 | 53962 | 2-10-2 | 1049_1 | CCctttaccactTT |

TABLE 2-continued

Sequence Motifs and Compounds of
Exemplary Compounds of the Invention

| SEQ ID NO | motif sequence | start | end | design | CMP ID NO | Oligonucleotide compound |
|---|---|---|---|---|---|---|
| 1050 | tcccttaccactt | 53950 | 53963 | 2-10-2 | 1050_1 | TCccttaccacTT |
| 1051 | atcccttaccact | 53951 | 53964 | 2-10-2 | 1051_1 | ATcccttaccaCT |
| 1052 | catcccttaccac | 53952 | 53965 | 2-10-2 | 1052_1 | CAtcccttaccAC |
| 1053 | ctacatctaacccc | 54550 | 54563 | 2-10-2 | 1053_1 | CTacatctaaccCC |
| 1054 | tctacatctaaccc | 54551 | 54564 | 2-10-2 | 1054_1 | TCtacatctaacCC |
| 1055 | gtctacatctaacc | 54552 | 54565 | 2-10-2 | 1055_1 | GTctacatctaaCC |
| 1056 | agtctacatctaac | 54553 | 54566 | 2-10-2 | 1056_1 | AGtctacatctaAC |
| 1057 | cagtctacatctaa | 54554 | 54567 | 2-10-2 | 1057_1 | CAgtctacatctAA |
| 1058 | tcagtctacatcta | 54555 | 54568 | 2-10-2 | 1058_1 | TCagtctacatcTA |
| 1059 | ttcagtctacatct | 54556 | 54569 | 2-10-2 | 1059_1 | TTcagtctacatCT |
| 1060 | taaccacacctcct | 54573 | 54586 | 2-10-2 | 1060_1 | TAaccacacctcCT |
| 1061 | ttaaccacacctcc | 54574 | 54587 | 2-10-2 | 1061_1 | TTaaccacacctCC |
| 1062 | tttaaccacacctc | 54575 | 54588 | 2-10-2 | 1062_1 | TTtaaccacaccTC |
| 1063 | ttttaaccacacct | 54576 | 54589 | 2-10-2 | 1063_1 | TTttaaccacacCT |
| 1064 | gttttaaccacacc | 54577 | 54590 | 2-10-2 | 1064_1 | GTtttaaccacaCC |
| 1065 | agttttaaccacac | 54578 | 54591 | 2-10-2 | 1065_1 | AGttttaaccacAC |
| 1066 | caacaaaacatcaa | 55228 | 55241 | 2-10-2 | 1066_1 | CAacaaaacatcAA |
| 1067 | tcaacaaaacatca | 55229 | 55242 | 2-10-2 | 1067_1 | TCaacaaaacatCA |
| 1068 | ttcaacaaaacatc | 55230 | 55243 | 2-10-2 | 1068_1 | TTcaacaaaacaTC |
| 1069 | tttcaacaaaacat | 55231 | 55244 | 2-10-2 | 1069_1 | TTtcaacaaaacAT |
| 1070 | ttttcaacaaaaca | 55232 | 55245 | 2-10-2 | 1070_1 | TTttcaacaaaaCA |
| 1071 | gttttcaacaaaac | 55233 | 55246 | 2-10-2 | 1071_1 | GTtttcaacaaaAC |
| 1072 | tgttttcaacaaaa | 55234 | 55247 | 2-10-2 | 1072_1 | TGttttcaacaaAA |
| 1073 | ttctaaaacttacc | 55269 | 55282 | 2-10-2 | 1073_1 | TTctaaaacttaCC |
| 1074 | tttctaaaacttac | 55270 | 55283 | 2-10-2 | 1074_1 | TTtctaaaacttAC |
| 1075 | ctttctaaaactta | 55271 | 55284 | 2-10-2 | 1075_1 | CTttctaaaactTA |
| 1076 | tctttctaaaactt | 55272 | 55285 | 2-10-2 | 1076_1 | TCtttctaaaacTT |
| 1077 | atctttctaaaact | 55273 | 55286 | 2-10-2 | 1077_1 | ATctttctaaaaCT |
| 1078 | aatctttctaaaac | 55274 | 55287 | 2-10-2 | 1078_1 | AAtctttctaaaAC |
| 1079 | gaatctttctaaaa | 55275 | 55288 | 2-10-2 | 1079_1 | GAatctttctaaAA |
| 1080 | agaatctttctaaa | 55276 | 55289 | 2-10-2 | 1080_1 | AGaatctttctaAA |
| 1081 | cagaatctttctaa | 55277 | 55290 | 2-10-2 | 1081_1 | CAgaatctttctAA |
| 1082 | cctttatttcctt | 55494 | 55507 | 2-10-2 | 1082_1 | CCtttatttcccTT |
| 1083 | ccctttatttccct | 55495 | 55508 | 2-10-2 | 1083_1 | CCctttatttccCT |
| 1084 | tccctttatttccc | 55496 | 55509 | 2-10-2 | 1084_1 | TCcctttatttcCC |
| 1085 | ttccctttatttcc | 55497 | 55510 | 2-10-2 | 1085_1 | TTccctttatttCC |
| 1086 | tttcccttattt c | 55498 | 55511 | 2-10-2 | 1086_1 | TTcccttattTC |

TABLE 2-continued

Sequence Motifs and Compounds of
Exemplary Compounds of the Invention

| SEQ ID NO | motif sequence | start | end | design | CMP ID NO | Oligonucleotide compound |
|---|---|---|---|---|---|---|
| 1087 | atttccctttattt | 55499 | 55512 | 2-10-2 | 1087_1 | ATttccctttatTT |
| 1088 | tatttccctttatt | 55500 | 55513 | 2-10-2 | 1088_1 | TAtttccctttaTT |
| 1089 | gtatttccctttat | 55501 | 55514 | 2-10-2 | 1089_1 | GTatttccctttAT |

Oligonucleotide compound represent specific designs of a motif sequence. Typically, capital letters represent beta-D-oxy LNA nucleosides, lowercase letters represent DNA nucleosides, all LNA C are 5-methyl cytosine, and 5-methyl DNA cytosines are presented by "e" or 'c, all internucleoside linkages are phosphorothioate internucleoside linkages.

Design refers to the gapmer design, F-G-F', where each number represents the number of consecutive modified nucleosides, e.g. 2' modified nucleosides (first number=5' flank), followed by the number of DNA nucleosides (second number=gap region), followed by the number of modified nucleosides, e.g. 2' modified nucleosides (third number=3' flank), optionally preceded by or followed by further repeated regions of DNA and LNA, which are not necessarily part of the contiguous nucleotide sequence that is complementary to the target nucleic acid.

Motif sequences represent the contiguous sequence of nucleobases present in the oligonucleotide, also referred to as the Oligonucleotide Base Sequence.

The invention provides antisense oligonucleotides according to the invention, such as antisense oligonucleotides 12-24, such as 12-18 in length, nucleosides in length wherein the antisense oligonucleotide comprises a contiguous nucleotide sequence comprising at least 12, such as at least 14, such as at least 15 contiguous nucleotides present in a of sequence selected from SEQ ID NO 4 to SEQ ID NO: 1089; SEQ ID Nos 1099 to 1127; and SEQ ID NO 1137-1988.

The antisense oligonucleotides provided herein typically comprise or consist of a contiguous nucleotide sequence selected from SEQ ID NO 4-1089. For example, the antisense oligonucletodies are LNA gapmers comprising or consisting of a contiguous nucleotide sequence selected from SEQ ID NO 4-1089.

In some embodiments, the antisense oligonucleotide of the present invention comprises or consists of a nucleotide sequence selected from SEQ ID NO 4-1089. For example, the antisense oligonucleotide of the present invention is a LNA gapmer comprising or consisting of a contiguous nucleotide sequence selected from SEQ ID NO 4-1089. Preferred compounds are listed in Table 2 above, see columns "Oligonucleotide compounds".

The invention provides antisense oligonucleotides according to the invention, such as antisense oligonucleotides 12-24, such as 12-18 in length, nucleosides in length wherein the antisense oligonucleotide comprises a contiguous nucleotide sequence comprising at least 12, such as at least 14, such as at least 15 contiguous nucleotides present in a sequence selected from SEQ ID NO 1190 to SEQ ID NO: 1136.

The invention provides antisense oligonucleotides according to the invention, such as antisense oligonucleotides 12-24, such as 12-18 in length, nucleosides in length wherein the antisense oligonucleotide comprises a contiguous nucleotide sequence comprising at least 12, such as at least 14, such as at least 15 contiguous nucleotides present in a sequence selected from SEQ ID NO 1190 to SEQ ID NO: 1136.

The antisense oligonucleotides provided herein typically comprise or consist of a contiguous nucleotide sequence selected from SEQ ID NO 1190-1136. For example, the antisense oligonucletodies are LNA gapmers comprising or consisting of a contiguous nucleotide sequence selected from SEQ ID NO 1190 to SEQ ID NO: 1136.

In some embodiments, the antisense oligonucleotide of the present invention comprises or consists of a nucleotide sequence selected from SEQ ID NO 1190-1136. For example, the antisense oligonucleotide of the present invention is a LNA gapmer comprising or consisting of a contiguous nucleotide sequence selected from SEQ ID NO 1190 to SEQ ID NO: 1136. See the examples for exemplary oligonucleotide of the invention.

The invention provides antisense oligonucleotides according to the invention, such as antisense oligonucleotides 12-24, such as 12-18 in length, nucleosides in length wherein the antisense oligonucleotide comprises a contiguous nucleotide sequence comprising at least 12, such as at least 14, such as at least 15 contiguous nucleotides present in a of sequence selected from SEQ ID NO 1137 to SEQ ID NO: 1989.

The antisense oligonucleotides provided herein typically comprise or consist of a contiguous nucleotide sequence selected from SEQ ID NO SEQ ID NO 1137 to SEQ ID NO: 1989. For example, the antisense oligonucletodies are LNA gapmers comprising or consisting of a contiguous nucleotide sequence selected from SEQ ID NO 1137 to SEQ ID NO: 1989.

In some embodiments, the antisense oligonucleotide of the present invention comprises or consists of a nucleotide sequence selected from SEQ ID NO 1137 to SEQ ID NO: 1989. For example, the antisense oligonucleotide of the present invention is a LNA gapmer comprising or consisting of a contiguous nucleotide sequence selected from SEQ ID NO 1137 to SEQ ID NO: 1989. See the examples for exemplary oligonucleotide of the invention.

In some embodiments, the invention refers to oligomeric compounds, capable of inhibiting the expression of ataxin3 in a cell which is expressing ataxin 3 (such as human ataxin 3), wherein the oligomeric compound comprises at least 10 contiguous nucleotides which are identical to a contiguous sequence of nucleobases present in a sequence selected from the group consisting of 4-1989.

In some embodiments, the invention refers to oligomeric compounds, capable of inhibiting the expression of ataxin3 in a cell which is expressing ataxin 3 (such as human ataxin 3), wherein the oligomeric compound comprises at least 12 contiguous nucleotides which are identical to a contiguous sequence of nucleobases present in a sequence selected from the group consisting of 4-1989.

In some embodiments, the invention refers to oligomeric compounds, capable of inhibiting the expression of ataxin3 in a cell which is expressing ataxin 3 (such as human ataxin 3), wherein the oligomeric compound comprises at least 14 contiguous nucleotides which are identical to a contiguous sequence of nucleobases present in a sequence selected from the group consisting of 4-1989.

In some embodiments, the invention refers to oligomeric compounds, capable of inhibiting the expression of ataxin3 in a cell which is expressing ataxin 3 (such as human ataxin 3), wherein the oligomeric compound comprises at least 16 contiguous nucleotides which are identical to a contiguous sequence of nucleobases present in a sequence selected from the group consisting of 4-1989.

In some embodiments, the invention refers to oligomeric compounds, capable of inhibiting the expression of ataxin3 in a cell which is expressing ataxin 3 (such as human ataxin 3), wherein the oligomeric compound comprises a contiguous nucleotides which are identical to the contiguous sequence of nucleobases shown in a sequence selected from the group consisting of 4-1989.

The invention provides antisense oligonucleotides selected from the group consisting of the antisense oligonucleotides listed in Table 2 in the column "Oligonucleotide compounds", wherein a capital letter is a LNA nucleoside, and a lower case letter is a DNA nucleoside. In some embodiments all internucleoside linkages in contiguous nucleoside sequence are phosphorothioate internucleoside linkages. Optionally LNA cytosine may be 5-methyl cytosine. Optionally DNA cytosine may be 5-methyl cytosine. Optionally uracil may be used in place of thymine bases.

The invention provides antisense oligonucleotides selected from the group consisting of the antisense oligonucleotides listed in Table 2 in the column "Oligonucleotide compounds", wherein a capital letter is a beta-D-oxy-LNA nucleoside, and a lower case letter is a DNA nucleoside. In some embodiments all internucleoside linkages in contiguous nucleoside sequence are phosphorothioate internucleoside linkages. Optionally LNA cytosine may be 5-methyl cytosine. Optionally DNA cytosine may be 5-methyl cytosine.

The invention provides antisense oligonucleotides selected from the group consisting of the antisense oligonucleotides listed in Table 2 in the column "Oligonucleotide compounds", wherein a capital letter is a ScET LNA nucleoside, and a lower case letter is a DNA nucleoside. In some embodiments all internucleoside linkages in contiguous nucleoside sequence are phosphorothioate internucleoside linkages. Optionally LNA cytosine may be 5-methyl cytosine. Optionally DNA cytosine may be 5-methyl cytosine.

The invention provides antisense oligonucleotides selected from the group consisting of the antisense oligonucleotides listed in Table 2 in the column "Oligonucleotide compounds", wherein a capital letter is a beta-D-oxy-LNA nucleoside, wherein all LNA cytosines are 5-methyl cytosine, and a lower case letter is a DNA nucleoside, wherein all internucleoside linkages in contiguous nucleoside sequence are phosphorothioate internucleoside linkages, and optionally DNA cytosine may be 5-methyl cytosine.

The invention provides antisense oligonucleotides selected from the group consisting of the antisense oligonucleotides listed in Table 2 in the column "Oligonucleotide compounds", wherein a capital letter is a ScET LNA nucleoside, wherein all LNA cytosines are 5-methyl cytosine, and a lower case letter is a DNA nucleoside, wherein all internucleoside linkages in contiguous nucleoside sequence are phosphorothioate internucleoside linkages, and optionally DNA cytosine may be 5-methyl cytosine.

Method of Manufacture

In a further aspect, the invention provides methods for manufacturing the oligonucleotides of the invention comprising reacting nucleotide units and thereby forming covalently linked contiguous nucleotide units comprised in the oligonucleotide. Preferably, the method uses phophoramidite chemistry (see for example Caruthers et al, 1987, Methods in Enzymology vol. 154, pages 287-313). In a further embodiment the method further comprises reacting the contiguous nucleotide sequence with a conjugating moiety (ligand) to covalently attach the conjugate moiety to the oligonucleotide. In a further aspect a method is provided for manufacturing the composition of the invention, comprising mixing the oligonucleotide or conjugated oligonucleotide of the invention with a pharmaceutically acceptable diluent, solvent, carrier, salt and/or adjuvant.

Pharmaceutical Composition

In a further aspect, the invention provides pharmaceutical compositions comprising any of the aforementioned oligonucleotides and/or oligonucleotide conjugates or salts thereof and a pharmaceutically acceptable diluent, carrier, salt and/or adjuvant.

In a further aspect, the invention provides pharmaceutical compositions comprising any of the aforementioned oligonucleotides and/or oligonucleotide conjugates or salts thereof and a pharmaceutically acceptable diluent, carrier, salt or adjuvant.

A pharmaceutically acceptable diluent includes phosphate-buffered saline (PBS) and pharmaceutically acceptable salts include, but are not limited to, sodium and potassium salts. In some embodiments the pharmaceutically acceptable diluent is sterile phosphate buffered saline. In some embodiments the oligonucleotide is used in the pharmaceutically acceptable diluent at a concentration of 50-300 µM solution.

The compounds according to the present invention may exist in the form of their pharmaceutically acceptable salts. The term "pharmaceutically acceptable salt" refers to conventional acid-addition salts or base-addition salts that retain the biological effectiveness and properties of the compounds of the present invention and are formed from suitable non-toxic organic or inorganic acids or organic or inorganic bases. Acid-addition salts include for example those derived from inorganic acids such as hydrochloric acid, hydrobromic acid, hydroiodic acid, sulfuric acid, sulfamic acid, phosphoric acid and nitric acid, and those derived from organic acids such as p-toluenesulfonic acid, salicylic acid, methanesulfonic acid, oxalic acid, succinic acid, citric acid, malic acid, lactic acid, fumaric acid, and the like. Base-addition salts include those derived from ammonium, potassium, sodium and, quaternary ammonium hydroxides, such as for example, tetramethyl ammonium hydroxide. The chemical modification of a pharmaceutical compound into a salt is a technique well known to pharmaceutical chemists in order to obtain improved physical and chemical stability, hygroscopicity, flowability and solubility of compounds. It is for example described in Bastin, Organic Process Research & Development 2000, 4, 427-435 or in Ansel, In: Pharmaceutical Dosage Forms and Drug Delivery Systems, 6th ed. (1995), pp. 196 and 1456-1457. For example, the pharmaceutically acceptable salt of the compounds provided herein may be a sodium salt.

Suitable formulations for use in the present invention are found in Remington's Pharmaceutical Sciences, Mack Publishing Company, Philadelphia, Pa., 17th ed., 1985. For a brief review of methods for drug delivery, see, e.g., Langer (Science 249:1527-1533, 1990). WO 2007/031091 provides further suitable and preferred examples of pharmaceutically acceptable diluents, carriers and adjuvants (hereby incorporated by reference). Suitable dosages, formulations, administration routes, compositions, dosage forms, combinations with other therapeutic agents, pro-drug formulations are also provided in WO2007/031091.

Oligonucleotides or oligonucleotide conjugates of the invention may be mixed with pharmaceutically acceptable active or inert substances for the preparation of pharmaceutical compositions or formulations. Compositions and methods for the formulation of pharmaceutical compositions are dependent upon a number of criteria, including, but not limited to, route of administration, extent of disease, or dose to be administered. These compositions may be sterilized by conventional sterilization techniques, or may be sterile filtered. The resulting aqueous solutions may be packaged for use as is, or lyophilized, the lyophilized preparation being combined with a sterile aqueous carrier prior to administration. The pH of the preparations typically will be between 3 and 11, more preferably between 5 and 9 or between 6 and 8, and most preferably between 7 and 8, such as 7 to 7.5. The resulting compositions in solid form may be packaged in multiple single dose units, each containing a fixed amount of the above-mentioned agent or agents, such as in a sealed package of tablets or capsules. The composition in solid form can also be packaged in a container for a flexible quantity, such as in a squeezable tube designed for a topically applicable cream or ointment.

In some embodiments, the oligonucleotide or oligonucleotide conjugate of the invention is a prodrug. In particular with respect to oligonucleotide conjugates the conjugate moiety is cleaved of the oligonucleotide once the prodrug is delivered to the site of action, e.g. the target cell.

Applications

The oligonucleotides of the invention may be utilized as research reagents for, for example, diagnostics, therapeutics and prophylaxis.

In research, such oligonucleotides may be used to specifically modulate the synthesis of ATXN3 protein in cells (e.g. in vitro cell cultures) and experimental animals thereby facilitating functional analysis of the target or an appraisal of its usefulness as a target for therapeutic intervention. Typically the target modulation is achieved by degrading or inhibiting the mRNA producing the protein, thereby prevent protein formation or by degrading or inhibiting a modulator of the gene or mRNA producing the protein.

If employing the oligonucleotide of the invention in research or diagnostics the target nucleic acid may be a cDNA or a synthetic nucleic acid derived from DNA or RNA.

The present invention provides an in vivo or in vitro method for modulating ATXN3 expression in a target cell which is expressing ATXN3, said method comprising administering an oligonucleotide of the invention in an effective amount to said cell.

In some embodiments, the target cell, is a mammalian cell in particular a human cell. The target cell may be an in vitro cell culture or an in vivo cell forming part of a tissue in a mammal.

In diagnostics the oligonucleotides may be used to detect and quantitate ATXN3 expression in cell and tissues by northern blotting, in-situ hybridisation or similar techniques.

For therapeutics, an animal or a human, suspected of having a disease or disorder, which can be treated by modulating the expression of ATXN3

The invention provides methods for treating or preventing a disease, comprising administering a therapeutically or prophylactically effective amount of an oligonucleotide, an oligonucleotide conjugate or a pharmaceutical composition of the invention to a subject suffering from or susceptible to the disease.

The invention also relates to an oligonucleotide, a composition or a conjugate as defined herein for use as a medicament.

The oligonucleotide, oligonucleotide conjugate or a pharmaceutical composition according to the invention is typically administered in an effective amount.

The invention also provides for the use of the oligonucleotide or oligonucleotide conjugate of the invention as described for the manufacture of a medicament for the treatment of a disorder as referred to herein, or for a method of the treatment of as a disorder as referred to herein.

The disease or disorder, as referred to herein, is associated with expression of ATXN3. In some embodiments disease or disorder may be associated with a mutation in the ATXN3 gene. Therefore, in some embodiments, the target nucleic acid is a mutated form of the ATXN3 sequence.

The methods of the invention are preferably employed for treatment or prophylaxis against diseases caused by abnormal levels and/or activity of ATXN3.

The invention further relates to use of an oligonucleotide, oligonucleotide conjugate or a pharmaceutical composition as defined herein for the manufacture of a medicament for the treatment of abnormal levels and/or activity of ATXN3.

In one embodiment, the invention relates to oligonucleotides, oligonucleotide conjugates or pharmaceutical compositions for use in the treatment of spinocerebellar ataxia.

Administration

In some embodiments, the oligonucleotides or pharmaceutical compositions of the present invention may be administered oral. In further embodiments, the oligonucleotides or pharmaceutical compositions of the present invention may be administered topical or enteral or parenteral (such as, intravenous, subcutaneous, intra-muscular, intracerebral, intracerebroventricular or intrathecal).

In a preferred embodiment the oligonucleotide or pharmaceutical compositions of the present invention are administered by a parenteral route including intravenous, intraarterial, subcutaneous, intraperitoneal or intramuscular injection or infusion, intrathecal or intracranial, e.g. intracerebral or intraventricular, intravitreal administration. In one embodiment the active oligonucleotide or oligonucleotide conjugate is administered intravenously. In another embodiment the active oligonucleotide or oligonucleotide conjugate is administered subcutaneously.

In some embodiments, the oligonucleotide, oligonucleotide conjugate or pharmaceutical composition of the invention is administered at a dose of 0.1-15 mg/kg, such as from 0.2-10 mg/kg, such as from 0.25-5 mg/kg. The administration can be once a week, every $2^{nd}$ week, every third week or even once a month.

Combination Therapies

In some embodiments the oligonucleotide, oligonucleotide conjugate or pharmaceutical composition of the invention is for use in a combination treatment with another therapeutic agent. The therapeutic agent can for example be the standard of care for the diseases or disorders described above.

Further Embodiments

The following further embodiments may be combined with the embodiments described elsewhere in the application or claims:

1. An antisense oligonucleotide, 10-30 nucleotides in length, wherein said antisense oligonucleotide comprises a contiguous nucleotide sequence 10-30 nucleotides in length, wherein the contiguous nucleotide sequence is at least 90% complementary, such as fully complementary to SEQ ID NO 1, wherein the antisense oligonucleotide is capable of inhibiting the expression of human ATXN3 in a cell which is expressing human ATXN3; or a pharmaceutically acceptable salt thereof.
2. The antisense oligonucleotide according to embodiment 1, wherein the contiguous nucleotide sequence is fully complementary to a region of SEQ ID NO 1, selected from the group consisting of 721-765; 786-820; 1012-1038; 1040-1080; 1186-1213; 2870-2915; 2944-2988; 3168-3206; 3210-3257; 3462-3493; 3880-3906; 3908-3977; 4094-4128; 4173-4203; 5098-5177; 5538-5560; 5690-5749; 6407-6450; 7401-7434; 7436-7521; 8609-8637; 8636-8676; 8693-8715; 9391-9414; 10943-11030; 11543-11563; 11942-11967; 12175-12204; 12206-12229; 12254-12324; 12327-12364; 12682-12708; 12739-12758; 13127-13197; 13289-13412; 13990-14031; 14041-14113; 14115-14138; 14257-14288; 14570-14612; 15778-15805; 15813-15848; 15850-15900; 16069-16115; 16187-16229; 16494-16527; 16834-16852; 16910-16956; 18012-18051; 18615-18650; 19085-19135; 20214-20241; 20554-20599; 22073-22096; 22251-22292; 22422-22447; 23196-23228; 23616-23637; 24071-24132; 24217-24383; 24486-24541; 24586-24615; 24739-24778; 24848-24888; 24975-24995; 25026-25117; 25499-25540; 27081-27233; 27771-27810; 27927-27953; 29297-29323; 29336-29445; 30705-30792; 31006-31111; 32057-32090; 33420-33470; 33792-33817; 33963-34002; 34050-34073; 34075-34103; 34523-34570; 35302-35378; 36322-36357; 36461-36500; 36786-36820; 36822-36862; 38848-38885; 40059-40091; 40149-40228; 40365-40399; 41655-41684; 41699-41720; 41773-41799; 42145-42218; 43826-43868; 45488-45508; 47371-47417; 48061-48117; 48894-48924; 48959-48996; 50076-50112; 51008-51031; 51826-51892; 53239-53301; 53688-53719; 53931-53967; 54550-54610; 55218-55258; 55269-55299; 55494-55514; or a pharmaceutically acceptable salt thereof.
3. The antisense oligonucleotide according to embodiment 1, wherein the contiguous nucleotide sequence is fully complementary to a region of SEQ ID NO 1, selected from the group consisting of 43-101; 721-736; 786-808; 1682-1698; 1682-1700; 1688-1703; 1688-1702; 1787-1801; 1832-1846; 2259-2273; 4296-4310; 4397-4411; 4402-4417; 4593-4611; 4598-4612; 4601-4615; 5031-5046; 5264-5278; 5564-5578; 6547-6567; 6676-6690; 7056-7073; 9078-9092; 9078-9093; 9079-9093; 9080-9094; 9781-9806; 9838-9854; 9857-9872; 9896-9911; 9940-9956; 9977-9992; 9977-9993; 9987-10003; 10110-10124; 10480-10510; 12330-12344; 12660-12677; 12660-12676; 12661-12677; 12787-12804; 12806-12852; 12869-12884; 12917-12931; 13317-13333; 13335-13363; 13578-13592; 15660-15676; 17803-17824; 17841-17857; 17868-17884; 18541-18556; 23358-23379; 23434-23448; 23450-23469; 23617-23632; 23843-23859; 23946-23961; 24338-24352; 25281-25296; 25634-25674; 27146-27163; 27182-27222; 27415-27434; 27415-27429; 27500-27517; 28239-28253; 28244-28258; 30158-30172; 32776-32790; 34946-34965; 35110-35124; 35331-35345; 35588-35602; 35597-35612; 40009-40023; 42239-42267; 43570-43585; 43789-43803; 43870-43884; 45381-45397; 47736-47750; 47758-47774; 48013-48035; 48037-48053; 49337-49353; 50653-50668; 50656-50670; 51424-51438; 56049-56063; and, 61333-61348; or a pharmaceutically acceptable salt thereof.
4. The antisense oligonucleotide according to any one of embodiments 1-3, wherein the contiguous nucleotide sequence comprises a region of at least 8 or at least 10 contiguous nucleotides which are fully complementary to a region of SEQ ID NO 1, selected from the group consisting of 743-760; 2969-2987; 4175-4191; 5131-5148; 7436-7453; 9395-9414; 12742-12758; 14572-14590; 16188-16207; 16924-16940; 18630-18647; 22074-22092; 23204-23221; 24509-24528; 27100-27119; 30115-30132; 32059-32078; 34075-34093; 35310-35329; 36470-36489; 38853-38871; 40158-40177; 41777-41794; 48905-48923; 51866-51882; and 53949-53965; or a pharmaceutically acceptable salt thereof.
5. The antisense oligonucleotide according to any one of embodiments 1-3, wherein the contiguous nucleotide sequence comprises a region of at least 12 or at least 14 contiguous nucleotides which are fully complementary to a region of SEQ ID NO 1, selected from the group consisting of 743-760; 2969-2987; 4175-4191; 5131-5148; 7436-7453; 9395-9414; 12742-12758; 14572-14590; 16188-16207; 16924-16940; 18630-18647; 22074-22092; 23204-23221; 24509-24528; 27100-27119; 30115-30132; 32059-32078; 34075-34093; 35310-35329; 36470-36489; 38853-38871; 40158-40177; 41777-41794; 48905-48923; 51866-51882; and 53949-53965; or a pharmaceutically acceptable salt thereof.
6. The antisense oligonucleotide according to any one of embodiments 1-5, wherein the antisense oligonucleotide is a gapmer oligonucleotide comprising a contiguous nucleotide sequence of formula 5'-F-G-F'-3', where region F and F' independently comprise 1-8 sugar modified nucleosides, and G is a region between 5 and 16 nucleosides which are capable of recruiting RNaseH; or a pharmaceutically acceptable salt thereof.
7. The antisense oligonucleotide according to embodiment 6, wherein the sugar modified nucleosides of region F and F' are independently selected from the group consisting of 2'-O-alkyl-RNA, 2'-O-methyl-RNA, 2'-alkoxy-RNA, 2'-O-methoxyethyl-RNA, 2'-amino-DNA, 2'-fluoro-DNA, arabino nucleic acid (ANA), 2'-fluoro-ANA and LNA nucleosides; or a pharmaceutically acceptable salt thereof.
8. The antisense oligonucleotide according to embodiment 5 or 6, wherein region G comprises 5-16 contiguous DNA nucleosides; or a pharmaceutically acceptable salt thereof.
9. The antisense oligonucleotide according to any one of embodiments 1-8, wherein the antisense oligonucleotide is a gapmer oligonucleotide such as an LNA gapmer oligonucleotide; or a pharmaceutically acceptable salt thereof.

10. The antisense oligonucleotide according to any one of embodiments 5-9, wherein the LNA nucleosides are beta-D-oxy LNA nucleosides; or a pharmaceutically acceptable salt thereof.
11. The antisense oligonucleotide according to any one of embodiments 1-10, wherein the internucleoside linkages between the contiguous nucleotide sequence are phosphorothioate internucleoside linkages; or a pharmaceutically acceptable salt thereof.
12. The antisense oligonucleotide according to any one of embodiments 1-11, wherein the oligonucleotide comprises a contiguous nucleotide sequence selected from the group consisting of SEQ ID NO 4 to SEQ ID NO: 1089; SEQ ID Nos 1099 to 1127; and SEQ ID NO 1137-1988; or a pharmaceutically acceptable salt thereof.
13. The antisense oligonucleotide according to any one of embodiments 1-13, wherein the oligonucleotide is an oligonucleotide compound selected from the oligonucleotide compounds shown in Table 2, wherein a capital letter represents a LNA nucleoside, a lower case letter represents a DNA nucleoside; or a pharmaceutically acceptable salt thereof.
14. The antisense oligonucleotide according to any one of embodiments 1-13, wherein the oligonucleotide is is an oligonucleotide compound selected from the oligonucleotide compounds shown in Table 2, wherein a capital letter represents a beta-D-oxy LNA nucleoside, a lower case letter represents a DNA nucleoside, wherein each LNA cytosine is 5-methyl cytosine, and wherein the internucleoside linkages between the nucleosides are phosphorothioate internucleoside linkages, or a pharmaceutically salt thereof; or a pharmaceutically acceptable salt thereof.
15. The antisense oligonucleotide according to any one of embodiments 1-13, wherein the compound is selected from the group consisting of compounds 1099_1 (SEQ ID NO: 1099), 1100_1 (SEQ ID NO: 1100), 1101_1 (SEQ ID NO: 1101), 1102_1 (SEQ ID NO: 1102), 1103_1 (SEQ ID NO: 1103), 1104_1 (SEQ ID NO: 1104), 1105_1 (SEQ ID NO: 1105), 1106_1 (SEQ ID NO: 1106), 1107_1 (SEQ ID NO: 1107), 1108_1 (SEQ ID NO: 1108), 1109_1 (SEQ ID NO: 1109), 1110_1 (SEQ ID NO: 1110), 1111_1 (SEQ ID NO: 11111, 1112_1 (SEQ ID NO: 1112), 1113_1 (SEQ ID NO: 1113), 1114_1 (SEQ ID NO: 1114), 1115_1 (SEQ ID NO: 1115), 1116_1 (SEQ ID NO: 1116), 1117_1 (SEQ ID NO: 1117), 1118_1 (SEQ ID NO: 1118), 1119_1 (SEQ ID NO: 1119), 1120_1 (SEQ ID NO: 1120), 1121_1 (SEQ ID NO: 1121), 1122_1 (SEQ ID NO: 1122), 1123_1 (SEQ ID NO: 1123), 1124_1 (SEQ ID NO: 1124), 1125_1 (SEQ ID NO: 1126), 1126_1 (SEQ ID NO: 1126), and 1127_1 (SEQ ID NO: 1127) or a oligonucleotide compound shown in the tables in Examples 2,3 or 4; or a pharmaceutically acceptable salt thereof.
16. A conjugate comprising the oligonucleotide according to any one of embodiments 1-15, and at least one conjugate moiety covalently attached to said oligonucleotide; or a pharmaceutically acceptable salt thereof.
17. A pharmaceutical composition comprising the oligonucleotide of embodiment 1-15 or the conjugate of embodiment 16 and a pharmaceutically acceptable diluent, solvent, carrier, salt and/or adjuvant.
18. An in vivo or in vitro method for modulating ATXN3 expression in a target cell which is expressing ATXN3, said method comprising administering an oligonucleotide or salt of any one of embodiments 1-15, the conjugate according to embodiment 16, or the pharmaceutical composition of embodiment 17 in an effective amount to said cell.
19. A method for treating or preventing a disease comprising administering a therapeutically or prophylactically effective amount of an oligonucleotide or salt of any one of embodiments 1-15 or the conjugate according to embodiment 16 or the pharmaceutical composition of embodiment 17 to a subject suffering from or susceptible to the disease.
20. The method of embodiment 19, wherein the disease is spinocerebellar ataxia, such as spinocerebellar ataxia 3, such as Machado-Joseph disease (MJD).
21. The oligonucleotide or salt of any one of embodiments 1-15 or the conjugate according to embodiment 16 or the pharmaceutical composition of embodiment 17 for use in medicine.
22. The oligonucleotide or salt of any one of embodiments 1-15 or the conjugate according to embodiment 16 or the pharmaceutical composition of embodiment 15 for use in the treatment or prevention of spinocerebellar ataxia, such as spinocerebellar ataxia 3, such as Machado-Joseph disease (MJD).
23. Use of the oligonucleotide or salt of embodiment 1-15 or the conjugate according to embodiment 16 or the pharmaceutical composition of embodiment 17, for the preparation of a medicament for treatment or prevention of spinocerebellar ataxia, such as spinocerebellar ataxia 3, such as Machado-Joseph disease (MJD).

EXAMPLES

Materials and Methods
Oligonucleotide Synthesis
Oligonucleotide synthesis is generally known in the art. Below is a protocol which may be applied. The oligonucleotides of the present invention may have been produced by slightly varying methods in terms of apparatus, support and concentrations used.

Oligonucleotides are synthesized on uridine universal supports using the phosphoramidite approach on an Oligomaker 48 at 1 µmol scale. At the end of the synthesis, the oligonucleotides are cleaved from the solid support using aqueous ammonia for 5-16 hours at 60'C. The oligonucleotides are purified by reverse phase HPLC (RP-HPLC) or by solid phase extractions and characterized by UPLC, and the molecular mass is further confirmed by ESI-MS.

Elongation of the Oligonucleotide:
The coupling of β-cyanoethyl-phosphoramidites (DNA-A(Bz), DNA-G(ibu), DNA-C(Bz), DNA-T, LNA-5-methyl-C(Bz), LNA-A(Bz), LNA-G(dmf), or LNA-T) is performed by using a solution of 0.1 M of the 5'-O-DMT-protected amidite in acetonitrile and DCI (4,5-dicyanoimidazole) in acetonitrile (0.25 M) as activator.

Purification by RP-HPLC:
The crude compounds are purified by preparative RP-HPLC on a Phenomenex Jupiter C18 10µ 150×10 mm column. 0.1 M ammonium acetate pH 8 and acetonitrile is used as buffers at a flow rate of 5 mL/min. The collected fractions are lyophilized to give the purified compound typically as a white solid.

Abbreviations

DCI: 4,5-Dicyanoimidazole
DCM: Dichloromethane

DMF: Dimethylformamide
DMT: 4,4'-Dimethoxytrityl
THF: Tetrahydrofurane
Bz: Benzoyl
Ibu: Isobutyryl
RP-HPLC: Reverse phase high performance liquid chromatography $T_m$ Assay:

Oligonucleotide and RNA target (phosphate linked, PO) duplexes are diluted to 3 mM in 500 ml RNase-free water and mixed with 500 ml $2 \times T_m$-buffer (200 mM NaCl, 0.2 mM EDTA, 20 mM Naphosphate, pH 7.0). The solution is heated to 95° C. for 3 min and then allowed to anneal in room temperature for 30 min. The duplex melting temperatures ($T_m$) is measured on a Lambda 40 UV/VIS Spectrophotometer equipped with a Peltier temperature programmer PTP6 using PE Templab software (Perkin Elmer). The temperature is ramped up from 20° C. to 95° C. and then down to 25° C., recording absorption at 260 nm. First derivative and the local maximums of both the melting and annealing are used to assess the duplex $T_m$.

Cell Lines

TABLE 3

Details in relation to the cell lines for assaying the compounds:

| | Cell lines | | | | Hours | |
|---|---|---|---|---|---|---|
| Name | Vendor | Cat.no. | Cell medium | Cells/well (96 well plate) | of cell incubation prior to treatment | Days of treatment |
| A431 | ECACC | 85090402 | EMEM (Cat.no. MM279), 10% FBS (Cat.no. F7524), 2 mM Glutamine (Cat.no. G8541), 0.1 mM NEAA (Cat.no. M7145), 25 µg/ml Gentamicin (Cat.no. G1397) | 8000 | 24 | 3 |
| NCI-H23 | ATCC | CRL-5800 | RPMI 1640 (Cat.no. R2405), 10% FBS (Cat.no. F7524), 10 mM Hepes (Cat.no. H0887), 1 mM Sodium Pyruvate (Cat.no. S8636), 25 µg/ml Gentamicin (Cat.no. G1397) | 10000 | 24 | 3 |
| ARPE19 | ATCC | CRL-2302 | DMEM/F-12 HAM (Cat.no. D8437), 10% FBS (Cat.no. F7524), 25 µg/ml Gentamicin (Cat.no. G1397) | 2000 | 0 | 4 |
| U251 | ECACC | 9063001 | EMEM (Cat.no. M2279), 10% FBS (Cat.no. F7524), 2 mM Glutamine (Cat.no. G8541), 0.1 mM NEAA (Cat.no. M7145), 1 mM Sodium Pyruvate (Cat.no. S8636), 25 µg/ml Gentamicin (Cat.no. G1397) | 2000 | 0 | 4 |
| U2-OS | ATCC | HTB-96 | MCCoy 5A medium (Cat.no. M8403), 10% FBS (Cat.no. F7524), 1.5 mM Glutamine | 7000 | 24 | 3 |

TABLE 3-continued

Details in relation to the cell lines for assaying the compounds:

| | Cell lines | | | | Hours | |
|---|---|---|---|---|---|---|
| Name | Vendor | Cat.no. | Cell medium | Cells/well (96 well plate) | of cell incubation prior to treatment | Days of treatment |
| SK-N-AS | ATCC | CRL-2137 | (Cat.no. G8541), 25 µg/ml Gentamicin (Cat.no. G1397) Dulbecco's Modified Eagle's Medium, supplemented with 0.1 mM Non-Essential Amino Acids (NEAA) and fetal bovine serum to a final concentration of 10% | 9300 | 24 | 4 |
| iCell GlutaNeurons | Stemcell Technologies | R1034 | BrainPhys Neuronal Medium (Cat.no. 5790) supplemented with iCell GlutaNeurons Kit (Stemcell Technoligies. no. R1034) according to vendor), N-2 (Thermo Fisher), 1 µg/ml Laminin 512 (BioLamina, no. LN521) | 50.000 | 168 | 4 |

*All medium and additives are purchased from Sigma Aldrich unless otherweise stated.

Example 1 Testing In Vitro Efficacy of LNA Oligonucleotides in SK-N-AS, A431, NCI-H23 and ARPE19 Cell Lines at 25 and 5 µM An oligonucleotide screen is performed in human cell lines using the LNA oligonucleotides in table 2 (CMP ID NO: 4_1-1089_1, see column "oligonucleotide compounds") targeting SEQ ID NO 1. The human cell lines SK-N-AS, A341, NCI-H23 and ARPE19 are purchased from the vendors listed in table 3, and are maintained as recommended by the supplier in a humidified incubator at 37° C. with 5% $CO_2$. For the screening assays, cells are seeded in 96 multi well plates in media recommended by the supplier (see table 3 in the Materials and Methods section). The number of cells/well is optimized for each cell line (see table 3 in the Materials and Methods section).

Cells are incubated between 0 and 24 hours before addition of the oligonucleotide in concentration of 5 or 25 µM (dissolved in PBS). 3-4 days after addition of the oligonucleotide, the cells are harvested (The incubation times for each cell line are indicated in table 3 in the Materials and Methods section).

RNA is extracted using the Qiagen RNeasy 96 kit (74182), according to the manufacturer's instructions). cDNA synthesis and qPCR is performed using qScript XLT one-step RT-qPCR ToughMix Low ROX, 95134-100 (Quanta Biosciences). Target transcript levels are quantified using FAM labeled TaqMan assays from Thermo Fisher Scientific in a multiplex reaction with a VIC labelled GUSB control. TaqMan primer assays for the target transcript of interest ATXN3 (see below) and a house keeping gene GUSB (4326320E VIC-MGB probe).

ATXN3 primer assay (Assay ID: N/A Item Name Hs.PT.58.39355049):

```
Forward primer:
                                       (SEQ ID NO 1128)
GTTTCTAAAGACATGGTCACAGC Reverse:
                                       (SEQ ID NO 1129)
CTATCAGGACAGAGTTCACATCC Probe:
                                       (SEQ ID NO 1130)
56-FAM/AAAGGCCAG/ZEN/CCACCAGTTCAGG/3IABkFQ/
```

The relative ATXN3 mRNA expression levels are determined as % of control (PBS-treated cells) i.e. the lower the value the larger the inhibition.

Example 2: In Vitro Reduction of ATXN3 in SK-N-AS Human Cell Line Using Further LNA Gapmer Oligonucleotides Targeting ATNX3

LNA modified oligonucleotides targeting human ATXN3 were tested for their ability to reduce ATXN3 mRNA expression in human SK-N-AS neuroblastoma cells acquired from ECACC Cat: 94092302. The cells were cultured according to the vendor guidelines in Dulbecco's Modified Eagles Medium, supplemented with 0.1 mM Non-Essential Amino Acids (NEAA) and fetal bovine serum to a final concentration of 10%. Cells were cultured at 37° C., 5% CO2 and 95% humidity in an active evaporation incubator (Thermo C10). Cells were seeded at a density of 9000 cells per well (96-well plate) in 190 ul of SK-N-AS cell culture medium. The cells were hereafter added 10 µl of oligo suspension or PBS (controls) to a final concentration of 5 µM from pre-made 96-well dilution plates. The cell culture plates were incubated for 72 hours in the incubator.

After incubation, cells were harvested by removal of media followed by cell lysis and RNA purification using QIAGEN RNeasy 96 Kit (cat 74181), following manufacturers protocol. RNA was diluted 2 fold in water prior to the one-step qPCR reaction. For one-step qPCR reaction qPCR-mix (qScript™ XLT One-Step RT-qPCR ToughMix® Low ROX from QuantaBio, cat. no 95134-500) and QPCR was run as duplex QPCR using assays from Integrated DNA technologies for ATXN3 (Hs.PT.58.39355049) and TBP (Hs.PT.58v.39858774)

```
Hs.PT.58.39355049-Primer Sequences
Probe:
                                (SEQ ID NO 1130)
5'-/56-FAM/AAAGGCCAG/ZEN/CCACCAGTTCAGG/3IABkFQ/-3'

Primer 1:
                                (SEQ ID NO 1129)
5'-CTATCAGGACAGAGTTCACATCC-3'

Primer 2:
                                (SEQ ID NO 1128)
5'-GTTTCTAAAGACATGGTCACAGC-3'

Hs.PT.58v.39858774-Primer Sequences
Probe:
                                (SEQ ID NO 1131)
5'-/5HEX/TGA TCT TTG/ZEN/CAG TGA CCC AGC ATC A/
3IABkFQ/-3'

Primer 1:
                                (SEQ ID NO 1132)
5'-GCT GTT TAA CTT CGC TTC CG-3'

Primer 2:
                                (SEQ ID NO 1133)
5'-CAG CAA CTT CCT CAA TTC CTT G-3'
```

The reactions were then mixed in a qPCR plate (MICROAMP®optical 384 well, 4309849). After sealing, the plate was given a quick spin, 1000 g for 1 minute at RT, and transferred to a Viia™ 7 system (Applied Biosystems, Thermo), and the following PCR conditions used: 50° C. for 15 minutes; 95° C. for 3 minutes; 40 cycles of: 95° C. for 5 sec followed by a temperature decrease of 1.6° C./sec followed by 60° C. for 45 sec. The data was analyzed using the QuantStudio™ Real_time PCR Software and quantity calculated by the delta delta Ct method (Quantity=2^(−Ct)*1000000000). Quantity is normalized to the calculated quantity for the housekeeping gene assay (TBP) run in the same well. Relative Target Quantity=QUANTITY_target/QUANTITY_housekeeping (RNA knockdown) was calculated for each well by division with the mean of all PBS-treated wells on the same plate. Normalised Target Quantity=(Relative Target Quantity/[mean] Relative Target Quantity]_pbs_wells)*100.

Compounds targeting selected target sequence regions of SEQ ID NO 1 were evaluated in the above assay.

The target knock-down data is presented in the following Compound and Data Table:

In the Compound table, motif sequences represent the contiguous sequence of nucleobases present in the oligonucleotide.

Oligonucleotide compound represent specific designs of a motif sequence. Capital letters represent beta-D-oxy LNA nucleosides, lowercase letters represent DNA nucleosides, all LNA C are 5-methyl cytosine, all internucleoside linkages are phosphorothioate internucleoside linkages.

TABLE 4

Compound and Data Table

| SEQID | CMPID | Oligonucleotide Base Sequence | Oligonucleotide compound | % of ATXN3 mRNA remaining |
|---|---|---|---|---|
| 1099 | 1099_1 | CCAAAAGAAACCAAACCC | CCAAagaaaccaaacCC | 90.6 |
| 1100 | 1100_1 | CCCCATTCAAATATTTATT | CCccattcaaatatttATT | 90.5 |
| 1101 | 1101_1 | AATCATTTACCCCCAAC | AAtcatttaccccCAAC | 92 |
| 1102 | 1102_1 | TATCTCAAACTATCCCCA | TAtctcaaactatcccCA | 93 |
| 1103 | 1103_1 | TCTATTCCTTAACCCAAC | TCTattccttaacccAAC | 76.6 |
| 1104 | 1104_1 | TCCCCTAAATAATTTAATCA | TCccctaaataatttaATCA | 79.3 |
| 1105 | 1105_1 | AAACCACTCCATTCCAA | AaaccactccattCCAA | 57.7 |
| 1106 | 1106_1 | TCTAAACCCCAAACTTTCA | TCtaaaccccaaactttCA | 74.3 |
| 1107 | 1107_1 | TTCTAAACCCCAAACTTTC | TTCtaaaccccaaacttTC | 61.8 |

TABLE 4-continued

Compound and Data Table

| SEQID | CMPID | Oligonucleotide Base Sequence | Oligonucleotide compound | % of ATXN3 mRNA remaining |
|---|---|---|---|---|
| 1108 | 1108_1 | AGTTCTAAACCCCAAACT | AGttctaaaccccaaACT | 73.7 |
| 1109 | 1109_1 | TGAAACCATTACTACAACC | TGaaaccattactacAACC | 24.9 |
| 1110 | 1110_1 | ACATCATTTATCACTACCAC | ACAtcatttatcactaccAC | 71.9 |
| 1111 | 1111_1 | AACATTAAACCCTCCCA | AacattaaaccctcCCA | 80.2 |
| 1112 | 1112_1 | TCAGATCCTAAAATCACT | TCAgatcctaaaatcACT | 79.5 |
| 1113 | 1113_1 | CTATACCTAAAACAATCTA | CTAtacctaaaacaatCTA | 99.1 |
| 1114 | 1114_1 | TGATTCTTATACTTACTA | TGAttcttatacttaCTA | 72.1 |
| 1115 | 1115_1 | TAAAAATATAACTACTCCTA | TAaaaatataactactCCTA | 93.7 |
| 1116 | 1116_1 | TCTTCATTATACCATCAAAT | TCTtcattataccatcaAAT | 51.5 |
| 1117 | 1117_1 | GTTTCATATTTTTAATCC | GTTtcatatttttaaTCC | 37.7 |
| 1118 | 1118_1 | TAATATCCTCATTACCCATT | TAatatcctcattacccaTT | 84 |
| 1119 | 1119_1 | CAAATATTCACAAATCCTA | CAaatattcacaaatCCTA | 73.3 |
| 1120 | 1120_1 | CATCACAAAATAACCTATCA | CATcacaaaataacctaTCA | 79.9 |
| 1121 | 1121_1 | CTCTCAACTTCTACTACTAA | CTCtcaacttctactactAA | 59.6 |
| 1122 | 1122_1 | AATCTTATTTACATCTTCC | AATcttatttacatctTCC | 20.7 |
| 1123 | 1123_1 | CCAAAATTACTTCTTTTATC | CCAaaattacttcttttATC | 56.5 |
| 1124 | 1124_1 | AACCCAACTTTCTATTTT | AACCcaactttctattTT | 52.7 |
| 1125 | 1125_1 | ACAATATATTCCTCAATCA | ACAatatattcctcaaTCA | 86.8 |
| 1126 | 1126_1 | CCTGTAACAATTATACA | CCTgtaacaattatACA | 92.3 |
| 1127 | 1127_1 | CATCCCTTTACCACTTT | CAtcccttaccactTT | 94.5 |

In the oligonucleotide compound column, capital letters represent beta-D-oxy LNA nucleosides, LNA cytosines are 5-methyl cytosine, lower case letters are DNA nucleosides, and all internucleoside linkages are phosphorothioate.

As can be seen, most of the above compounds targeting the listed target sequence regions are capable of inhibiting the expression of the human ataxin 3 transcript and that compounds targeting the target sequence region complementary to SEQ ID Nos 1122 and 1109 are particularly effective in inhibiting the human ataxin 3 transcript. Other effective target sites for ATXN3 can be determined from the above table.

Example 3

The screening assay described in Example 2 was performed using a series of further oligonucleotide targeting human ATXN3 pre-mRNA using the qpCR: (ATXN3_exon_8-9(1) PrimeTime® XL qPCR Assay (IDT).

qPCR probe and primers set 2:

Probe:
(SEQ ID NO 1134)
5'-/56-FAM/CTCCGCAGG/ZEN/GCT ATTCAGCT AAGT/31ABkFQ/-3'

Primer 1:
(SEQ ID NO 1135)
5'-AGT AAGATTTGT ACCTGATGTCTGT-3'

Primer 2:
(SEQ ID NO 1136)
5'-CATGGAAGATGAGGAAGCAGAT-3'

The results are shown in the following table.

TABLE 5

| SEQID | CMPID | Oligonucleotide Base Sequence | Oligonucleotide compound | % of ATXN3 mRNA remaining |
|---|---|---|---|---|
| 1137 | 1137_1 | CCTACTTCACTTCCTAA | CctacttcacttcCTAA | 68.9 |
| 1138 | 1138_1 | TTTCCTACTTCACTTCCTA | TttcctacttcacttccTA | 95.1 |
| 1139 | 1139_1 | TTCCTACTTCACTTCCTA | TtcctacttcacttcCTA | 85 |
| 1140 | 1140_1 | TTTCCTACTTCACTTCCT | TTtcctacttcacttcCT | 88.1 |
| 1141 | 1141_1 | TTTCCTACTTCACTTCC | TttcctacttcactTCC | 83.1 |
| 1142 | 1142_1 | GTTTCCTACTTCACTTC | GTTtcctacttcactTC | 60.2 |
| 1143 | 1143_1 | ACCAAACCCAAACATCCC | AccaaacccaaacatcCC | 88 |
| 1144 | 1144_1 | AGAAACCAAACCCAAACATC | AgaaaccaaacccaaaCATC | 91.3 |
| 1145 | 1145_1 | AGAAACCAAACCCAAACAT | AGaaaccaaacccaaACAT | 93.5 |
| 1146 | 1146_1 | CTCCTAATACCTAAAAACAAA | CTCCtaatacctaaaaacaAA | 100 |
| 1147 | 1147_1 | CTCCTAATACCTAAAAACA | CTCCtaatacctaaaaaCA | 94.2 |
| 1148 | 1148_1 | ACTCCTAATACCTAAAAACA | ACTCctaatacctaaaaaCA | 81 |
| 1149 | 1149_1 | CACTCCTAATACCTAAAAACA | CACtcctaatacctaaaaACA | 90.4 |
| 1150 | 1150_1 | CCACTCCTAATACCTAAAAA | CCACtcctaatacctaaaAA | 63 |
| 1151 | 1151_1 | TCCACTCCTAATACCTAAAAA | TCCactcctaatacctaaaAA | 54 |
| 1152 | 1152_1 | CCACTCCTAATACCTAAAA | CCACtcctaatacctaaAA | 73.7 |
| 1153 | 1153_1 | TCCACTCCTAATACCTAAAA | TCCactcctaatacctaAAA | 59 |
| 1154 | 1154_1 | CCACTCCTAATACCTAAA | CCACtcctaatacctaAA | 65.2 |
| 1155 | 1155_1 | GTCCACTCCTAATACCTAAA | GtccactcctaataccTAAA | 86.8 |
| 1156 | 1156_1 | CCACTCCTAATACCTAA | CCactcctaatacCTAA | 52.3 |
| 1157 | 1157_1 | TCCACTCCTAATACCTAA | TCcactcctaatacCTAA | 64.3 |
| 1157 | 1157_2 | TCCACTCCTAATACCTAA | TCCactcctaatacctAA | 66 |
| 1158 | 1158_1 | GTCCACTCCTAATACCTAA | GtccactcctaataccTAA | 85.5 |
| 1159 | 1159_1 | AGTCCACTCCTAATACCTA | AgtccactcctaataccTA | 87.4 |
| 1160 | 1160_1 | TCCACTCCTAATACCTA | TCcactcctaatacCTA | 70.1 |
| 1161 | 1161_1 | AGTCCACTCCTAATACCT | AgtccactcctaatacCT | 84.2 |
| 1162 | 1162_1 | GTCCACTCCTAATACC | GTCcactcctaataCC | 57.8 |
| 1163 | 1163_1 | AGTCCACTCCTAATACC | AGtccactcctaataCC | 77.1 |
| 1164 | 1164_1 | CAGTCCACTCCTAATACC | CagtccactcctaatACC | 86.7 |
| 1162 | 1162_2 | GTCCACTCCTAATACC | GTCcactcctaatACC | 67.8 |
| 1165 | 1165_1 | CCAGTCCACTCCTAATAC | CcagtccactcctaaTAC | 85.4 |
| 1166 | 1166_1 | CAGTCCACTCCTAATAC | CAgtccactcctaaTAC | 60.7 |
| 1167 | 1167_1 | AGTCCACTCCTAATAC | AGTCcactcctaatAC | 78.9 |
| 1168 | 1168_1 | CAGTCCACTCCTAATA | CAGtccactcctaaTA | 44.5 |
| 1169 | 1169_1 | CCAGTCCACTCCTAATA | CCagtccactcctaaTA | 33.8 |
| 1170 | 1170_1 | GCAACTCTTTCCAAACA | GCAactctttccaaaCA | 36 |
| 1171 | 1171_1 | AGCAACTCTTTCCAAACA | AGcaactctttccaaaCA | 35.3 |
| 1172 | 1172_1 | CAGCAACTCTTTCCAAACA | CAgcaactctttccaaACA | 58.3 |

TABLE 5-continued

| SEQID | CMPID | Oligonucleotide Base Sequence | Oligonucleotide compound | % of ATXN3 mRNA remaining |
|---|---|---|---|---|
| 1173 | 1173_1 | CCAGCAACTCTTTCCAAA | CcagcaactctttcCAAA | 69.7 |
| 1174 | 1174_1 | CCAGCAACTCTTTCCAA | CCagcaactctttcCAA | 42.1 |
| 1175 | 1175_1 | ACCAGCAACTCTTTCCAA | ACcagcaactctttcCAA | 65 |
| 1176 | 1176_1 | TTACCAGCAACTCTTTC | TTACcagcaactcttTC | 53 |
| 1177 | 1177_1 | TGCTCCTCCTATTAAATAA | TGCtcctcctattaaatAA | 76.3 |
| 1178 | 1178_1 | GCTCCTCCTATTAAATAA | GCtcctcctattaaATAA | 61.8 |
| 1179 | 1179_1 | GCTCCTCCTATTAAATA | GCtcctcctattaaATA | 60.2 |
| 1180 | 1180_1 | TGCTCCTCCTATTAAATA | TGctcctcctattaaATA | 70.2 |
| 1181 | 1181_1 | TGCTCCTCCTATTAAAT | TGCtcctcctattaaAT | 80.2 |
| 1182 | 1182_1 | TTGCTCCTCCTATTAAAT | TTGCtcctcctattaaAT | 79 |
| 1183 | 1183_1 | ATTTAATAAAACAAAAACCCT | ATttaataaaacaaaaaCCCT | 97.2 |
| 1184 | 1184_1 | GCCCAAAAAACTAAATT | GCCCaaaaaactaaaTT | 95.5 |
| 1185 | 1185_1 | GTTTTTACATTCTAACTT | GTTtttacattctaaCTT | 54.1 |
| 1186 | 1186_1 | TGTTTTTACATTCTAACT | TGTTtttacattctaaCT | 63.8 |
| 1187 | 1187_1 | CTGTTTTTACATTCTAAC | CTGTttttacattctaAC | 62.5 |
| 1188 | 1188_1 | CCCCATTCAAATATTTAT | CCCcattcaaatattTAT | 64.9 |
| 1189 | 1189_1 | GCCCCATTCAAATATTTAT | GCcccattcaaatattTAT | 86.2 |
| 1188 | 1188_2 | CCCCATTCAAATATTTAT | CCCCattcaaatatttAT | 96.2 |
| 1190 | 1190_1 | GCCCCATTCAAATATTTA | GCcccattcaaatatTTA | 82.2 |
| 1191 | 1191_1 | CCATTCAAATATATACATTTT | CCATtcaaatatatacattTT | 72 |
| 1191 | 1191_2 | CCATTCAAATATATACATTTT | CCATtcaaataTatacattTT | 37.7 |
| 1192 | 1192_1 | TCCATTCAAATATATACATTT | TCCAttcaaatatatacatTT | 56.8 |
| 1193 | 1193_1 | ATCCATTCAAATATATACATT | ATCCattcaaaTatatacaTT | 48 |
| 1194 | 1194_1 | TCCATTCAAATATATACATT | TCCAttcaaatatatacaTT | 53.7 |
| 1193 | 1193_2 | ATCCATTCAAATATATACATT | ATCCattcaaatatatacaTT | 54.7 |
| 1195 | 1195_1 | TATCCATTCAAATATATACAT | TATccattcaaatatataCAT | 80.1 |
| 1196 | 1196_1 | TCCATTCAAATATATACAT | TCCattcaaatatataCAT | 43.1 |
| 1197 | 1197_1 | ATCCATTCAAATATATACA | ATCCattcaaatatataCA | 53.9 |
| 1198 | 1198_1 | TTATCCATTCAAATATATACA | TTatccattcaaatataTACA | 69.4 |
| 1199 | 1199_1 | TCCATTCAAATATATACA | TCCAttcaaatatataCA | 54.7 |
| 1200 | 1200_1 | TATCCATTCAAATATATACA | TATCcattcaaatatataCA | 53.3 |
| 1201 | 1201_1 | CTTTATCCATTCAAATATATA | CTttatccattcaaataTATA | 85.5 |
| 1202 | 1202_1 | TCTTTATCCATTCAAATATAT | TCTttatccattcaaataTAT | 62.6 |
| 1203 | 1203_1 | CTCTTTATCCATTCAAATATA | CTCtttatccattcaaatATA | 38.4 |
| 1204 | 1204_1 | TCTTTATCCATTCAAATATA | TCtttatccattcaaaTATA | 70.9 |
| 1203 | 1203_2 | CTCTTTATCCATTCAAATATA | CTCTttatccattcaaataTA | 33.6 |
| 1205 | 1205_1 | CTTTATCCATTCAAATATA | CTttatccattcaaaTATA | 78.4 |

TABLE 5-continued

| SEQID | CMPID | Oligonucleotide Base Sequence | Oligonucleotide compound | % of ATXN3 mRNA remaining |
|---|---|---|---|---|
| 1206 | 1206_1 | TCTCTTTATCCATTCAAATAT | TCtctttatccattcaaaTAT | 82 |
| 1207 | 1207_1 | CTCTTTATCCATTCAAATAT | CTCtttatccattcaaaTAT | 39.8 |
| 1208 | 1208_1 | TCTTTATCCATTCAAATAT | TCTttatccattcaaaTAT | 63.1 |
| 1209 | 1209_1 | TCTCTTTATCCATTCAAATA | TCtctttatccattcaAATA | 65.2 |
| 1210 | 1210_1 | CTCTTTATCCATTCAAATA | CTCTttatccattcaaaTA | 32.2 |
| 1211 | 1211_1 | TCTCTTTATCCATTCAAAT | TCTctttatccattcaaAT | 42 |
| 1212 | 1212_1 | TCTCTTTATCCATTCAAA | TCTCtttatccattcaAA | 42.5 |
| 1213 | 1213_1 | AGCACCATATATATCTCA | AgcaccatatatatCTCA | 16 |
| 1214 | 1214_1 | GCACCATATATATCTCA | GCaccatatatatcTCA | 16 |
| 1215 | 1215_1 | CAGCACCATATATATCTCA | CagcaccatatatatCTCA | 19.2 |
| 1215 | 1215_2 | CAGCACCATATATATCTCA | CAgcaccatatatatcTCA | 24.1 |
| 1216 | 1216_1 | AGCACCATATATATCTC | AGcaccatatatatcTC | 19.9 |
| 1217 | 1217_1 | GCACCATATATATCTC | GCACcatatatatcTC | 82.7 |
| 1218 | 1218_1 | CAGCACCATATATATCTC | CAgcaccatatatatCTC | 21.1 |
| 1219 | 1219_1 | CAGCACCATATATATCT | CAGcaccatatataTCT | 28.9 |
| 1220 | 1220_1 | ACAGCACCATATATATCT | ACAGcaccatatatatCT | 21.9 |
| 1221 | 1221_1 | ACAGCACCATATATATC | ACAGcaccatatataTC | 25.4 |
| 1222 | 1222_1 | CTATGTTATTATCCCCA | CTAtgttattatcccCA | 56.1 |
| 1223 | 1223_1 | TCTATGTTATTATCCCC | TctatgttattatcCCC | 47.7 |
| 1224 | 1224_1 | CTCTACACTCTAACTCT | CtctacactctaaCTCT | 79.3 |
| 1225 | 1225_1 | TCTCTACACTCTAACTCT | TctctacactctaaCTCT | 79.6 |
| 1226 | 1226_1 | TTCTCTACACTCTAACTCT | TTCtctacactctaactCT | 86.9 |
| 1227 | 1227_1 | CTTCTCTACACTCTAACTCT | CTtctctacactctaactCT | 97 |
| 1227 | 1227_2 | CTTCTCTACACTCTAACTCT | CttctctacactctaacTCT | 84.5 |
| 1228 | 1228_1 | TTCTCTACACTCTAACTC | TTCtctacactctaacTC | 81.4 |
| 1229 | 1229_1 | CTTCTCTACACTCTAACTC | CttctctacactctaaCTC | 89.1 |
| 1230 | 1230_1 | TCTCTACACTCTAACTC | TCtctacactctaaCTC | 87.3 |
| 1231 | 1231_1 | CCTTCTCTACACTCTAACTC | CcttctctacactctaacTC | 98.3 |
| 1232 | 1232_1 | TTCTCTACACTCTAACT | TTCTctacactctaaCT | 80.1 |
| 1233 | 1233_1 | CTTCTCTACACTCTAACT | CTTctctacactctaaCT | 73.6 |
| 1234 | 1234_1 | CCTTCTCTACACTCTAACT | CcttctctacactctAACT | 77.7 |
| 1235 | 1235_1 | CCTTCTCTACACTCTAAC | CCTtctctacactctaAC | 82.4 |
| 1236 | 1236_1 | CTTCTCTACACTCTAAC | CTtctctacactcTAAC | 90.6 |
| 1237 | 1237_1 | AGCCTTCTCTACACTCTAA | AgccttctctacactcTAA | 80 |
| 1238 | 1238_1 | CCTTCTCTACACTCTAA | CCttctctacactcTAA | 72.2 |
| 1239 | 1239_1 | GCCTTCTCTACACTCTAA | GCcttctctacactctAA | 62.9 |
| 1240 | 1240_1 | AGCCTTCTCTACACTCTA | AgccttctctacactcTA | 85.2 |
| 1241 | 1241_1 | TACTAACTACAACACAAATCA | TACtaactacaacacaaaTCA | 91.3 |

TABLE 5-continued

| SEQID | CMPID | Oligonucleotide Base Sequence | Oligonucleotide compound | % of ATXN3 mRNA remaining |
|---|---|---|---|---|
| 1241 | 1241_2 | TACTAACTACAACACAAATCA | TACtaactacAacacaaaTCA | 81.1 |
| 1242 | 1242_1 | CTACTAACTACAACACAAATC | CTACtaactacaacacaaaTC | 108 |
| 1243 | 1243_1 | CACTACTAACTACAACACAAA | CACTactaactacaacacaAA | 74 |
| 1244 | 1244_1 | CACTACTAACTACAACACAA | CACtactaactacaacaCAA | 87.4 |
| 1245 | 1245_1 | ACACTACTAACTACAACACAA | ACActactaactacaacaCAA | 84.1 |
| 1246 | 1246_1 | CACTACTAACTACAACACA | CACTactaactacaacaCA | 83.5 |
| 1247 | 1247_1 | ACACTACTAACTACAACACA | ACACtactaactacaacaCA | 81.3 |
| 1248 | 1248_1 | GACACTACTAACTACAACAC | GACactactaactacaaCAC | 51.6 |
| 1249 | 1249_1 | GACACTACTAACTACAACA | GACActactaactacaaCA | 51 |
| 1250 | 1250_1 | AGACACTACTAACTACAA | AGAcactactaactaCAA | 57.2 |
| 1251 | 1251_1 | AGACACTACTAACTACA | AGACactactaactaCA | 34.7 |
| 1252 | 1252_1 | ATCATTTACCCCCAACCT | AtcatttaccccccaacCT | 96 |
| 1253 | 1253_1 | ATCATTTACCCCCAACC | AtcatttaccccccAACC | 89.1 |
| 1254 | 1254_1 | CAAATCATTTACCCCCAA | CaaatcatttaccccCAA | 92 |
| 1255 | 1255_1 | CCAAATCATTTACCCCCAA | CcaaatcatttaccccCAA | 91 |
| 1256 | 1256_1 | ACCAAATCATTTACCCCCA | AccaaatcatttaccccCA | 89.9 |
| 1257 | 1257_1 | TACCAAATCATTTACCCCC | TaccaaatcatttacccCC | 84 |
| 1258 | 1258_1 | ACCAAATCATTTACCCC | ACcaaatcatttacCCCC | 69.9 |
| 1259 | 1259_1 | TACCAAATCATTTACCCC | TACcaaatcatttaccCC | 56.3 |
| 1260 | 1260_1 | CTACCAAATCATTTACCCC | CtaccaaatcatttaccCC | 94 |
| 1261 | 1261_1 | TACCAAATCATTTACCC | TAccaaatcattTACCC | 68.9 |
| 1262 | 1262_1 | CTACCAAATCATTTACC | CTACcaaatcatttaCC | 70.3 |
| 1263 | 1263_1 | TGCTACCAAATCATTTACC | TgctaccaaatcattTACC | 79 |
| 1264 | 1264_1 | GCTACCAAATCATTTACC | GCtaccaaatcatttACC | 83.6 |
| 1265 | 1265_1 | TGCTACCAAATCATTTAC | TGCTaccaaatcatttAC | 88.3 |
| 1266 | 1266_1 | GCTACCAAATCATTTAC | GCTaccaaatcattTAC | 71.4 |
| 1267 | 1267_1 | TGCTACCAAATCATTTA | TGCtaccaaatcatTTA | 79.8 |
| 1268 | 1268_1 | CTGCTACCAAATCATTTA | CTGctaccaaatcatTTA | 75.3 |
| 1269 | 1269_1 | ACTGCTACCAAATCATTT | ACTGctaccaaatcatTT | 83.4 |
| 1270 | 1270_1 | CTGCTACCAAATCATTT | CTGCtaccaaatcatTT | 83 |
| 1271 | 1271_1 | ACTGCTACCAAATCATT | ACTGctaccaaatcaTT | 71.1 |
| 1272 | 1272_1 | CACTTTGCCATAATCAA | CactttgccataaTCAA | 26 |
| 1273 | 1273_1 | TTATCTCAAACTATCCCCA | TTAtctcaaactatcccCA | 92.9 |
| 1274 | 1274_1 | ATCTCAAACTATCCCCA | ATctcaaactatccCCA | 72.3 |
| 1275 | 1275_1 | CTTATCTCAAACTATCCCCA | CttatctcaaactatcccCA | 85.5 |
| 1276 | 1276_1 | TATCTCAAACTATCCCC | TatctcaaactatcCCC | 79.8 |
| 1277 | 1277_1 | CTTATCTCAAACTATCCCC | CTtatctcaaactatccCC | 84 |

TABLE 5-continued

| SEQID | CMPID | Oligonucleotide Base Sequence | Oligonucleotide compound | % of ATXN3 mRNA remaining |
|---|---|---|---|---|
| 1278 | 1278_1 | TTATCTCAAACTATCCCC | TTAtctcaaactatccCC | 89.7 |
| 1279 | 1279_1 | CTTATCTCAAACTATCCC | CttatctcaaactaTCCC | 83.5 |
| 1280 | 1280_1 | CCTTATCTCAAACTATCCC | CcttatctcaaactatcCC | 87.6 |
| 1279 | 1279_2 | CTTATCTCAAACTATCCC | CTtatctcaaactatCCC | 76.9 |
| 1281 | 1281_1 | TTATCTCAAACTATCCC | TtatctcaaactaTCCC | 84.7 |
| 1282 | 1282_1 | CTTATCTCAAACTATCC | CTTatctcaaactaTCC | 78.3 |
| 1283 | 1283_1 | CCCTTATCTCAAACTATCC | CccttatctcaaactaTCC | 76.4 |
| 1284 | 1284_1 | CCTTATCTCAAACTATCC | CCTtatctcaaactatCC | 69.3 |
| 1285 | 1285_1 | CCTTATCTCAAACTATC | CCttatctcaaacTATC | 75.9 |
| 1286 | 1286_1 | GCCCTTATCTCAAACTATC | GCccttatctcaaactaTC | 76.6 |
| 1287 | 1287_1 | CCCTTATCTCAAACTATC | CCcttatctcaaacTATC | 67.2 |
| 1288 | 1288_1 | TGCCCTTATCTCAAACTAT | TgcccttatctcaaacTAT | 90.5 |
| 1289 | 1289_1 | GCCCTTATCTCAAACTAT | GCccttatctcaaacTAT | 71.9 |
| 1290 | 1290_1 | CCCTTATCTCAAACTAT | CCCTtatctcaaactAT | 77.7 |
| 1291 | 1291_1 | GCCCTTATCTCAAACTA | GCccttatctcaaacTA | 68.4 |
| 1292 | 1292_1 | TGCCCTTATCTCAAACTA | TgcccttatctcaaaCTA | 81.5 |
| 1293 | 1293_1 | TGCCCTTATCTCAAACT | TGcccttatctcaaaCT | 75.7 |
| 1294 | 1294_1 | TTGCCCTTATCTCAAAC | TTGCccttatctcaaAC | 89 |
| 1295 | 1295_1 | CTTGCCCTTATCTCAA | CTtgcccttatcTCAA | 48.2 |
| 1296 | 1296_1 | TGAAATCAAACTTCATCA | TGAaatcaaacttcaTCA | 66.5 |
| 1297 | 1297_1 | GGTCACCATACTTAAT | GGTCaccatacttaAT | 89.7 |
| 1298 | 1298_1 | TGCTAACACAAATTTCCT | TGctaacacaaattTCCT | 47.3 |
| 1299 | 1299_1 | GCTAACACAAATTTCCT | GCTaacacaaatttCCT | 48.9 |
| 1299 | 1299_2 | GCTAACACAAATTTCCT | GCtaacacaaattTCCT | 45.7 |
| 1300 | 1300_1 | TTGCTAACACAAATTTCC | TTGCtaacacaaatttCC | 60.7 |
| 1301 | 1301_1 | TGCTAACACAAATTTCC | TGCTaacacaaatttCC | 62.6 |
| 1302 | 1302_1 | TTGCTAACACAAATTTC | TTGCtaacacaaattTC | 72.4 |
| 1303 | 1303_1 | CCTTTGCTAACACAAAT | CCTTtgctaacacaaAT | 48.1 |
| 1304 | 1304_1 | GTATAACCAATAATAACTA | GTAtaaccaataataaCTA | 86.1 |
| 1305 | 1305_1 | TCTGACATCACACAATTT | TCTGacatcacacaatTT | 67.8 |
| 1306 | 1306_1 | TCTGACATCACACAATT | TCTGacatcacacaaTT | 70.2 |
| 1307 | 1307_1 | TATCTGACATCACACAA | TATctgacatcacaCAA | 69.8 |
| 1308 | 1308_1 | CTATTCCTTAACCCAAC | CTattccttaaccCAAC | 77.7 |
| 1309 | 1309_1 | GTCTATTCCTTAACCCAAC | GtctattccttaaccCAAC | 86.2 |
| 1310 | 1310_1 | GTCTATTCCTTAACCCAA | GtctattccttaacCCAA | 60.4 |
| 1311 | 1311_1 | TCTATTCCTTAACCCAA | TCTattccttaaccCAA | 51 |
| 1312 | 1312_1 | GTCTATTCCTTAACCCA | GtctattccttaacCCA | 67.3 |
| 1313 | 1313_1 | GTCTATTCCTTAACCC | GtctattccttaaCCC | 77.4 |

TABLE 5-continued

| SEQID | CMPID | Oligonucleotide Base Sequence | Oligonucleotide compound | % of ATXN3 mRNA remaining |
|---|---|---|---|---|
| 1314 | 1314_1 | GGTCTATTCCTTAACC | GGtctattccttaaCC | 83.2 |
| 1315 | 1315_1 | AGAACATTTCCTTCTCCT | AgaacatttccttctcCT | 84.2 |
| 1316 | 1316_1 | AACTGTCCCAAACAACC | AACtgtcccaaacaaCC | 75 |
| 1317 | 1317_1 | TTAGTCTCCCTCATTTTC | TtagtctccctcattTTC | 72.4 |
| 1318 | 1318_1 | ATTTAGTCTCCCTCATT | ATttagtctccctCATT | 48 |
| 1319 | 1319_1 | ATGCATCAAATCTCATA | ATGCatcaaatctcaTA | 83.7 |
| 1320 | 1320_1 | CCTAAATAATTTAATCATTAA | CCTaaataatttaatcatTAA | 94 |
| 1321 | 1321_1 | CCCTAAATAATTTAATCATTA | CCCTaaataatttaatcatTA | 88.8 |
| 1322 | 1322_1 | CCCCTAAATAATTTAATCATT | CCCCtaaataatttaatcATT | 80.7 |
| 1323 | 1323_1 | CCCTAAATAATTTAATCATT | CCCTaaataatttaatcaTT | 82.2 |
| 1324 | 1324_1 | CCCTAAATAATTTAATCAT | CCCtaaataatttaatCAT | 87.1 |
| 1325 | 1325_1 | CCCCTAAATAATTTAATCA | CCCctaaataatttaaTCA | 79.9 |
| 1326 | 1326_1 | CCCTAAATAATTTAATCA | CCCtaaataatttaaTCA | 82.5 |
| 1327 | 1327_1 | CCCCTAAATAATTTAATC | CCCCtaaataatttaaTC | 116 |
| 1328 | 1328_1 | TCCCCTAAATAATTTAATC | TCCCctaaataatttaaTC | 109 |
| 1329 | 1329_1 | TTGCTAATATTTCCAAAA | TTGCtaatatttccaaAA | 84.2 |
| 1330 | 1330_1 | CTTGCTAATATTTCCAA | CTtgctaatatttCCAA | 66.1 |
| 1331 | 1331_1 | ACTGTCATCCATATTTCC | ActgtcatccatattTCC | 66.2 |
| 1332 | 1332_1 | ACTGTCATCCATATTTC | ACTgtcatccatatTTC | 48.1 |
| 1333 | 1333_1 | AATGCCCCACTCTAATAT | AATGccccactctaatAT | 36.9 |
| 1334 | 1334_1 | TGCCCCACTCTAATAT | TGCcccactctaatAT | 52.8 |
| 1335 | 1335_1 | ATGCCCCACTCTAATAT | ATgccccactctaaTAT | 43.7 |
| 1336 | 1336_1 | AAATGCCCCACTCTAATA | AAATgccccactctaaTA | 25.7 |
| 1337 | 1337_1 | ATGCCCCACTCTAATA | ATGccccactctaaTA | 28.6 |
| 1338 | 1338_1 | AATGCCCCACTCTAATA | AATGccccactctaaTA | 29.9 |
| 1339 | 1339_1 | TTAAATGCCCCACTCTA | TtaaatgccccactCTA | 51.3 |
| 1340 | 1340_1 | TCTGAAAATTCACTATCT | TCTGaaaattcactatCT | 35.7 |
| 1341 | 1341_1 | GTCTACTATATACATCT | GTCtactatatacaTCT | 30.6 |
| 1342 | 1342_1 | AGTCTACTATATACATCT | AGTCtactatatacatCT | 45.3 |
| 1343 | 1343_1 | AGTCTACTATATACATC | AGTCtactatatacaTC | 57 |
| 1344 | 1344_1 | GTCTACTATATACATC | GTCTactatatacaTC | 46.5 |
| 1345 | 1345_1 | TAGTCTACTATATACATC | TAgtctactatataCATC | 68.3 |
| 1346 | 1346_1 | TAGTCTACTATATACAT | TAGtctactatataCAT | 89 |
| 1347 | 1347_1 | CTAGTCTACTATATACAT | CTAgtctactatataCAT | 86.6 |
| 1348 | 1348_1 | CTAGTCTACTATATACA | CTAGtctactatataCA | 88.5 |
| 1349 | 1349_1 | ACTAGTCTACTATATAC | ACTagtctactataTAC | 85.1 |
| 1350 | 1350_1 | CTAGTCTACTATATAC | CTAgtctactataTAC | 85.3 |

TABLE 5-continued

| SEQID | CMPID | Oligonucleotide Base Sequence | Oligonucleotide compound | % of ATXN3 mRNA remaining |
|---|---|---|---|---|
| 1351 | 1351_1 | GTATATTCTACCCATAA | GTAtattctacccaTAA | 51.3 |
| 1352 | 1352_1 | TGTATATTCTACCCATAA | TGTatattctacccaTAA | 48.4 |
| 1353 | 1353_1 | TGTATATTCTACCCATA | TGtatattctaccCATA | 45.6 |
| 1354 | 1354_1 | ATGTATATTCTACCCATA | ATgtatattctaccCATA | 90.2 |
| 1355 | 1355_1 | ATGTATATTCTACCCAT | ATgtatattctacCCAT | 51.1 |
| 1356 | 1356_1 | GAAAACCACACAATTCCTA | GaaaaccacacaattCCTA | 58.9 |
| 1357 | 1357_1 | GAAAACCACACAATTCCT | GAaaaccacacaatTCCT | 56.4 |
| 1358 | 1358_1 | AGAAAACCACACAATTCCT | AGaaaaccacacaattCCT | 58.4 |
| 1359 | 1359_1 | CAGAAAACCACACAATTCC | CAGaaaaccacacaatTCC | 43.3 |
| 1360 | 1360_1 | AGAAAACCACACAATTCC | AGAaaaccacacaatTCC | 47.6 |
| 1361 | 1361_1 | CCAGAAAACCACACAATTC | CCAGaaaaccacacaatTC | 26.3 |
| 1362 | 1362_1 | CCAGAAAACCACACAATT | CCAGaaaaccacacaaTT | 21 |
| 1363 | 1363_1 | TCCAGAAAACCACACAAT | TCCAgaaaaccacacaAT | 47.1 |
| 1364 | 1364_1 | TTCCAGAAAACCACACAA | TTCCagaaaaccacacAA | 49.8 |
| 1364 | 1364_2 | TTCCAGAAAACCACACAA | TTCcagaaaaccacaCAA | 45.8 |
| 1365 | 1365_1 | GATATATCACTAAATCCAT | GAtatatcactaaatCCAT | 27.4 |
| 1366 | 1366_1 | GATATATCACTAAATCCA | GAtatatcactaaaTCCA | 43.7 |
| 1367 | 1367_1 | AGATATATCACTAAATCCA | AGatatatcactaaaTCCA | 37.4 |
| 1368 | 1368_1 | AGATATATCACTAAATCC | AGAtatatcactaaaTCC | 33.6 |
| 1369 | 1369_1 | TCATATATAAATTTCTCTA | TCAtatataaatttctCTA | 78 |
| 1369 | 1369_2 | TCATATATAAATTTCTCTA | TCATatataaatttctcTA | 73.1 |
| 1370 | 1370_1 | TCATATATAAATTTCTCT | TCatatataaatttCTCT | 27.9 |
| 1370 | 1370_2 | TCATATATAAATTTCTCT | TCATatataaatttctCT | 60.2 |
| 1371 | 1371_1 | AAGATCACACAACCATA | AAGAtcacacaaccaTA | 19.8 |
| 1372 | 1372_1 | TAAAAGATCACACAACCA | TAaaagatcacacaACCA | 47.5 |
| 1373 | 1373_1 | CATCACATAAAAACCCACTT | CATcacataaaaacccaCTT | 45.4 |
| 1374 | 1374_1 | CATCACATAAAAACCCACT | CAtcacataaaaaccCACT | 57.9 |
| 1375 | 1375_1 | TCATCACATAAAAACCCACT | TCatcacataaaaaccCACT | 30.1 |
| 1376 | 1376_1 | CATCACATAAAAACCCAC | CAtcacataaaaaCCAC | 61.6 |
| 1377 | 1377_1 | TCATCACATAAAAACCCAC | TCatcacataaaaacCCAC | 30.6 |
| 1378 | 1378_1 | GTCATCACATAAAAACCCAC | GTcatcacataaaaaccCAC | 24.9 |
| 1379 | 1379_1 | GTCATCACATAAAAACCCA | GTcatcacataaaaacCCA | 28.7 |
| 1380 | 1380_1 | TCATCACATAAAAACCCA | TCatcacataaaaaCCCA | 43.9 |
| 1381 | 1381_1 | CATCACATAAAAACCCA | CAtcacataaaaaCCCA | 71.5 |
| 1382 | 1382_1 | TCATCACATAAAAACCC | TCatcacataaaaaCCC | 42.9 |
| 1383 | 1383_1 | GTCATCACATAAAAACCC | GTcatcacataaaaaCCC | 24.9 |
| 1384 | 1384_1 | AGTCATCACATAAAAACCC | AGtcatcacataaaaACCC | 35.8 |
| 1384 | 1384_2 | AGTCATCACATAAAAACCC | AGTCatcacataaaaacCC | 23 |

TABLE 5-continued

| SEQID | CMPID | Oligonucleotide Base Sequence | Oligonucleotide compound | % of ATXN3 mRNA remaining |
|---|---|---|---|---|
| 1385 | 1385_1 | TAGTCATCACATAAAAACC | TAGTcatcacataaaaaCC | 36.3 |
| 1386 | 1386_1 | AGTCATCACATAAAAACC | AGTCatcacataaaaaCC | 34.9 |
| 1387 | 1387_1 | ATGCTAAATACAAATCT | ATGCtaaatacaaatCT | 81 |
| 1388 | 1388_1 | GAAACCATTACTACAACCAA | GAaaccattactacaaCCAA | 20.1 |
| 1389 | 1389_1 | GAAACCATTACTACAACCA | GAaaccattactacaACCA | 15.9 |
| 1390 | 1390_1 | ATGAAACCATTACTACAAC | ATGAaaccattactacaAC | 45.6 |
| 1391 | 1391_1 | CATGAAACCATTACTACA | CATGaaaccattactaCA | 55.9 |
| 1392 | 1392_1 | CCATGAAACCATTACTAC | CCatgaaaccattaCTAC | 29.5 |
| 1393 | 1393_1 | CTCCCATGAAACCATTA | CTCCcatgaaaccatTA | 73.7 |
| 1394 | 1394_1 | TGCTTACTTTATACAAAA | TGCTtactttatacaaAA | 55.9 |
| 1395 | 1395_1 | ATGTTAATACTTTTTCCA | ATGttaatacttttCCA | 92.9 |
| 1396 | 1396_1 | CCTAATTTAACCCACAA | CCTaatttaacccaCAA | 32.2 |
| 1397 | 1397_1 | ATCCTAATTTAACCCACAA | ATCctaatttaacccaCAA | 38.1 |
| 1398 | 1398_1 | TCCTAATTTAACCCACAA | TCCtaatttaacccaCAA | 39.9 |
| 1399 | 1399_1 | TAATCCTAATTTAACCCACAA | TAAtcctaatttaacccaCAA | 72.8 |
| 1400 | 1400_1 | TAATCCTAATTTAACCCACA | TAatcctaatttaaccCACA | 45 |
| 1401 | 1401_1 | AATCCTAATTTAACCCACA | AATCctaatttaacccaCA | 41.2 |
| 1402 | 1402_1 | TCCTAATTTAACCCACA | TCCtaatttaacccACA | 38.3 |
| 1403 | 1403_1 | TAATCCTAATTTAACCCAC | TAatcctaatttaacCCAC | 37.5 |
| 1404 | 1404_1 | ATCCTAATTTAACCCAC | ATcctaatttaacCCAC | 34.4 |
| 1405 | 1405_1 | AATCCTAATTTAACCCAC | AAtcctaatttaacCCAC | 48.2 |
| 1406 | 1406_1 | TAATCCTAATTTAACCCA | TAatcctaatttaaCCCA | 56.5 |
| 1407 | 1407_1 | AATCCTAATTTAACCCA | AAtcctaatttaaCCCA | 71.7 |
| 1408 | 1408_1 | GTAATCCTAATTTAACCCA | Gtaatcctaatttaaccca | 63.6 |
| 1409 | 1409_1 | TAATCCTAATTTAACCC | TAatcctaatttaACCC | 56.5 |
| 1410 | 1410_1 | GTAATCCTAATTTAACCC | GTaatcctaatttaACCC | 44 |
| 1411 | 1411_1 | AGTAATCCTAATTTAACCC | AGtaatcctaatttaaCCC | 66.2 |
| 1410 | 1410_2 | GTAATCCTAATTTAACCC | GTAatcctaatttaaCCC | 34.2 |
| 1412 | 1412_1 | AGTAATCCTAATTTAACC | AGTAatcctaatttaaCC | 42.7 |
| 1413 | 1413_1 | TCATTTATCACTACCACA | TCAtttatcactaccACA | 26.5 |
| 1414 | 1414_1 | CATCATTTATCACTACCACA | CatcatttatcactacCACA | 46 |
| 1415 | 1415_1 | CATTTATCACTACCACA | CAtttatcactacCACA | 19.4 |
| 1416 | 1416_1 | ATCATTTATCACTACCACA | ATcatttatcactacCACA | 16.8 |
| 1416 | 1416_2 | ATCATTTATCACTACCACA | ATCatttatcactaccaCA | 14.1 |
| 1417 | 1417_1 | ACATCATTTATCACTACCACA | ACatcatttatcactaccACA | 53.4 |
| 1418 | 1418_1 | TCATTTATCACTACCAC | TCAtttatcactacCAC | 18.9 |
| 1419 | 1419_1 | ATCATTTATCACTACCAC | ATcatttatcactaCCAC | 21.8 |

TABLE 5-continued

| SEQID | CMPID | Oligonucleotide Base Sequence | Oligonucleotide compound | % of ATXN3 mRNA remaining |
|---|---|---|---|---|
| 1420 | 1420_1 | CATCATTTATCACTACCAC | CATcatttatcactacCAC | 25.1 |
| 1421 | 1421_1 | AACATCATTTATCACTACCAC | AACatcatttatcactacCAC | 30.5 |
| 1421 | 1421_2 | AACATCATTTATCACTACCAC | AacatcatttatcactaCCAC | 40.4 |
| 1420 | 1420_2 | CATCATTTATCACTACCAC | CatcatttatcactaCCAC | 34.3 |
| 1422 | 1422_1 | AACATCATTTATCACTACCA | AAcatcatttatcactACCA | 34 |
| 1423 | 1423_1 | CATCATTTATCACTACCA | CATCatttatcactacCA | 11.3 |
| 1424 | 1424_1 | TAACATCATTTATCACTACCA | TAacatcatttatcactaCCA | 63.1 |
| 1425 | 1425_1 | ACATCATTTATCACTACCA | ACATcatttatcactacCA | 19 |
| 1422 | 1422_2 | AACATCATTTATCACTACCA | AACatcatttatcactaCCA | 25 |
| 1424 | 1424_2 | TAACATCATTTATCACTACCA | TaacatcatttatcactACCA | 61.3 |
| 1425 | 1425_2 | ACATCATTTATCACTACCA | ACatcatttatcactACCA | 23.5 |
| 1426 | 1426_1 | TAACATCATTTATCACTACC | TAACatcatttatcactaCC | 33.6 |
| 1427 | 1427_1 | ACATCATTTATCACTACC | ACatcatttatcacTACC | 32.3 |
| 1428 | 1428_1 | TTAACATCATTTATCACTACC | TTAacatcatttatcactaCC | 75.5 |
| 1429 | 1429_1 | AACATCATTTATCACTACC | AACAtcatttatcactaCC | 37.3 |
| 1430 | 1430_1 | TTAACATCATTTATCACTAC | TTaacatcatttatcaCTAC | 69.1 |
| 1431 | 1431_1 | TAACATCATTTATCACTAC | TAacatcatttatcaCTAC | 66.6 |
| 1432 | 1432_1 | ATTAACATCATTTATCACTAC | ATtaacatcatttatcaCTAC | 84.2 |
| 1432 | 1432_2 | ATTAACATCATTTATCACTAC | ATtaacatcAtttatcaCTAC | 62.8 |
| 1433 | 1433_1 | ATTAACATCATTTATCACTA | ATTaacatcatttatcaCTA | 81.3 |
| 1434 | 1434_1 | TTAACATCATTTATCACTA | TTAacatcatttatcaCTA | 74.5 |
| 1435 | 1435_1 | TAATTAACATCATTTATCACT | TAattaacatcatttatCACT | 84.3 |
| 1435 | 1435_2 | TAATTAACATCATTTATCACT | TAattaacaTcatttatCACT | 43.3 |
| 1436 | 1436_1 | CTAATTAACATCATTTATCAC | CTaattaacatcatttaTCAC | 81.4 |
| 1436 | 1436_2 | CTAATTAACATCATTTATCAC | CTaattaacAtcatttaTCAC | 46.7 |
| 1437 | 1437_1 | CCTAATTAACATCATTTATCA | CCtaattaacatcatttaTCA | 93.8 |
| 1438 | 1438_1 | CTAATTAACATCATTTATCA | CTAattaacatcatttaTCA | 89.6 |
| 1439 | 1439_1 | CCTAATTAACATCATTTATC | CCTAattaacatcatttaTC | 69.4 |
| 1440 | 1440_1 | CCCTAATTAACATCATTTATC | CCctaattaacatcatttATC | 86.3 |
| 1441 | 1441_1 | CCTAATTAACATCATTTAT | CCTaattaacatcattTAT | 87.4 |
| 1442 | 1442_1 | CCTAATTAACATCATTTA | CCTAattaacatcattTA | 66 |
| 1443 | 1443_1 | CCCTAATTAACATCATTTA | CCCtaattaacatcattTA | 88.7 |
| 1444 | 1444_1 | GCCCTAATTAACATCATTT | GCCctaattaacatcatTT | 87.9 |
| 1445 | 1445_1 | CCCTAATTAACATCATTT | CCCTaattaacatcatTT | 75.6 |
| 1446 | 1446_1 | CGGCCCTAATTAACAT | CGGCcctaattaacAT | 103 |
| 1447 | 1447_1 | CTCGGCCCTAATTAA | CTCggccctaatTAA | 57.4 |
| 1448 | 1448_1 | CACATATAACATATAAACACA | CACAtataacatataaacaCA | 61.7 |
| 1449 | 1449_1 | TCACATATAACATATAAACAC | TCAcatataacatataaaCAC | 43.6 |

TABLE 5-continued

| SEQID | CMPID | Oligonucleotide Base Sequence | Oligonucleotide compound | % of ATXN3 mRNA remaining |
|---|---|---|---|---|
| 1450 | 1450_1 | ACTATCACATATAACATATA | ACTAtcacatataacataTA | 58.5 |
| 1451 | 1451_1 | CACTATCACATATAACATATA | CACtatcacatataacataTA | 28.1 |
| 1452 | 1452_1 | CACTATCACATATAACATAT | CACtatcacatataacaTAT | 52 |
| 1453 | 1453_1 | CACTATCACATATAACATA | CACtcacatataacaTA | 24.3 |
| 1454 | 1454_1 | CACTATCACATATAACAT | CACtcacatataaCAT | 40.1 |
| 1455 | 1455_1 | CACTATCACATATAACA | CACtcacatataaCA | 27 |
| 1456 | 1456_1 | CAAAGTTTTCCCATTAC | CAaagttttcccaTTAC | 21 |
| 1457 | 1457_1 | ACAAAGTTTTCCCATTA | ACAaagttttcccaTTA | 20.5 |
| 1458 | 1458_1 | TCAGTCCAACATAACTC | TCAGtccaacataacTC | 15.2 |
| 1459 | 1459_1 | CAGTCCAACATAACTC | CAGtccaacataaCTC | 23.5 |
| 1460 | 1460_1 | ATCAGTCCAACATAACTC | ATCAgtccaacataacTC | 13.7 |
| 1461 | 1461_1 | ATCAGTCCAACATAACT | ATCAgtccaacataaCT | 15.9 |
| 1462 | 1462_1 | TAAACATTAAACCCTCCCAAA | TAaacattaaaccctccCAAA | 87 |
| 1463 | 1463_1 | AACATTAAACCCTCCCAA | AAcattaaaccctcCCAA | 68.4 |
| 1464 | 1464_1 | TAAACATTAAACCCTCCCAA | Taaacattaaaccctc CCAA | 79.2 |
| 1465 | 1465_1 | AAACATTAAACCCTCCCAA | AAacattaaaccctcCCAA | 70.8 |
| 1466 | 1466_1 | TATAAACATTAAACCCTCCCA | TAtaaacattaaaccctccCA | 94 |
| 1467 | 1467_1 | AACATTAAACCCTCCC | AAcattaaacccTCCC | 78.3 |
| 1468 | 1468_1 | AAACATTAAACCCTCCC | AAacattaaacccTCCC | 89.4 |
| 1469 | 1469_1 | TAAACATTAAACCCTCCC | TAAacattaaaccctCCC | 72.9 |
| 1470 | 1470_1 | ATAAACATTAAACCCTCCC | AtaaacattaaacccTCCC | 86 |
| 1471 | 1471_1 | TATAAACATTAAACCCTCC | TAtaaacattaaaccCTCC | 91.1 |
| 1472 | 1472_1 | TAAACATTAAACCCTCC | TAaacattaaaccCTCC | 82.2 |
| 1473 | 1473_1 | ACTATAAACATTAAACCCTCC | ActataaacattaaaccCTCC | 86.5 |
| 1474 | 1474_1 | ATAAACATTAAACCCTCC | ATaaacattaaaccCTCC | 88.4 |
| 1475 | 1475_1 | AACTATAAACATTAAACCCTC | AActataaacattaaacCCTC | 92.6 |
| 1476 | 1476_1 | CTATAAACATTAAACCCTC | CTataaacattaaacCCTC | 82.9 |
| 1477 | 1477_1 | ACTATAAACATTAAACCCTC | ACtataaacattaaacCCTC | 89.8 |
| 1478 | 1478_1 | AAACTATAAACATTAAACCCT | AAactataaacattaaaCCCT | 98.9 |
| 1479 | 1479_1 | CTATAAACATTAAACCCT | CTataaacattaaaCCCT | 82.2 |
| 1480 | 1480_1 | ACTATAAACATTAAACCCT | ACtataaacattaaaCCCT | 86.6 |
| 1481 | 1481_1 | AACTATAAACATTAAACCCT | AActataaacattaaaCCCT | 89.5 |
| 1482 | 1482_1 | GCTTTAAACTATAAACATT | GCtttaaactataaaCATT | 58.2 |
| 1483 | 1483_1 | TGCTTTAAACTATAAACA | TGCTttaaactataaaCA | 57.2 |
| 1484 | 1484_1 | CAGATTTATCACTATTA | CAGAtttatcactatTA | 15.4 |
| 1485 | 1485_1 | TCACAGCCTATCACCAC | TCacagcctatcacCAC | 47.3 |
| 1485 | 1485_2 | TCACAGCCTATCACCAC | TCAcagcctatcaccAC | 46.3 |

TABLE 5-continued

| SEQID | CMPID | Oligonucleotide Base Sequence | Oligonucleotide compound | % of ATXN3 mRNA remaining |
|---|---|---|---|---|
| 1486 | 1486_1 | ATCACAGCCTATCACCA | AtcacagcctatcACCA | 56.9 |
| 1486 | 1486_2 | ATCACAGCCTATCACCA | ATCacagcctatcacCA | 23.7 |
| 1487 | 1487_1 | AATCACAGCCTATCACC | AATCacagcctatcaCC | 32.9 |
| 1487 | 1487_2 | AATCACAGCCTATCACC | AatcacagcctatCACC | 52.2 |
| 1488 | 1488_1 | ATCACAGCCTATCACC | AtcacagcctatCACC | 60.1 |
| 1489 | 1489_1 | GCGTCACCCAAATCAC | GCgtcacccaaatCAC | 11 |
| 1490 | 1490_1 | AGCGTCACCCAAATCA | AG$^m$cgtcacccaaaTCA | 17.4 |
| 1491 | 1491_1 | AGCGTCACCCAAATC | AG$^m$cgtcacccaAATC | 18.8 |
| 1492 | 1492_1 | CAGATCCTAAAATCACT | CAGAtcctaaaatcaCT | 71.8 |
| 1493 | 1493_1 | TCAGATCCTAAAATCAC | TCAgatcctaaaatCAC | 66.2 |
| 1494 | 1494_1 | AGTAAAACCAATCATCAT | AGTaaaaccaatcatCAT | 30.8 |
| 1495 | 1495_1 | AGTAAAACCAATCATCA | AGTaaaaccaatcaTCA | 24.2 |
| 1496 | 1496_1 | CCCTTCCATCTCTACTAAAA | CccttccatctctactaaAA | 89.7 |
| 1497 | 1497_1 | ATAACTACATAACAAACCCA | ATaactacataacaaaCCCA | 69.1 |
| 1498 | 1498_1 | AATAACTACATAACAAACCCA | AAtaactacataacaaaCCCA | 77.8 |
| 1499 | 1499_1 | AACTACATAACAAACCCA | AActacataacaaaCCCA | 62.9 |
| 1500 | 1500_1 | TAACTACATAACAAACCCA | TAactacataacaaaCCCA | 65 |
| 1501 | 1501_1 | ACTACATAACAAACCCA | ACtacataacaaaCCCA | 60.4 |
| 1502 | 1502_1 | CAATAACTACATAACAAACCC | CAAtaactacataacaaaCCC | 72.6 |
| 1503 | 1503_1 | ATAACTACATAACAAACCC | ATaactacataacaaaCCC | 60.2 |
| 1504 | 1504_1 | ACAATAACTACATAACAAACC | ACAataactacataacaaACC | 78.5 |
| 1504 | 1504_2 | ACAATAACTACATAACAAACC | ACAAtaactacataacaaaCC | 80.9 |
| 1505 | 1505_1 | TGAATTCACAATAACTACA | TGaattcacaataacTACA | 38.1 |
| 1506 | 1506_1 | GCACATTTTTCTTAAACT | GCAcattttttcttaaaCT | 62.2 |
| 1507 | 1507_1 | GCTATACCTAAAACAATCT | GCTataccctaaaacaaTCT | 62.2 |
| 1508 | 1508_1 | GCTATACCTAAAACAATC | GCTAtaccctaaaacaaTC | 68.9 |
| 1509 | 1509_1 | CCCTTGTAACTAAAAAT | CCCtgtaactaaaaAT | 100 |
| 1510 | 1510_1 | CCCCTTGTAACTAAAAA | CCCCttgtaactaaaAA | 86.1 |
| 1511 | 1511_1 | CCCCTTGTAACTAAAA | CCCCttgtaactaaAA | 101 |
| 1512 | 1512_1 | ACCCCTTGTAACTAAA | ACCCcttgtaactaAA | 88.8 |
| 1513 | 1513_1 | CACCCCTTGTAACTAA | CAccccttgtaaCTAA | 80.4 |
| 1514 | 1514_1 | ACACCCCTTGTAACTA | ACAccccttgtaacTA | 72.4 |
| 1515 | 1515_1 | GCTAAAACTAATCATCT | GCTaaaactaatcaTCT | 72.2 |
| 1516 | 1516_1 | GGCTAAAACTAATCAT | GGCtaaaactaatCAT | 70.8 |
| 1517 | 1517_1 | TTACCCTTCATATATACATCT | TtacccttcatatatacaTCT | 89.4 |
| 1518 | 1518_1 | ATTACCCTTCATATATACATC | AttacccttcatatataCATC | 82.4 |
| 1519 | 1519_1 | TTACCCTTCATATATACATC | TTaccccttcatatatacATC | 56.3 |
| 1520 | 1520_1 | CATTACCCTTCATATATACAT | CAttaccccttcatatataCAT | 84.2 |

TABLE 5-continued

| SEQID | CMPID | Oligonucleotide Base Sequence | Oligonucleotide compound | % of ATXN3 mRNA remaining |
|---|---|---|---|---|
| 1521 | 1521_1 | TTACCCTTCATATATACAT | TTAcccttcatatataCAT | 55.3 |
| 1522 | 1522_1 | ATTACCCTTCATATATACAT | ATTaccccttcatatataCAT | 49.3 |
| 1523 | 1523_1 | ACATTACCCTTCATATATACA | ACAttacccttcatatataCA | 55.2 |
| 1523 | 1523_2 | ACATTACCCTTCATATATACA | AcattacccttcatataTACA | 63.4 |
| 1524 | 1524_1 | TTACCCTTCATATATACA | TTAcccttcatatataCA | 46.9 |
| 1525 | 1525_1 | CATTACCCTTCATATATACA | CattacccttcatataTACA | 66 |
| 1526 | 1526_1 | ATTACCCTTCATATATACA | ATTaccccttcatatataCA | 36.7 |
| 1527 | 1527_1 | ATTACCCTTCATATATAC | ATTaccccttcatataTAC | 46.6 |
| 1528 | 1528_1 | TTACCCTTCATATATAC | TTAcccttcatataTAC | 56.9 |
| 1529 | 1529_1 | CATTACCCTTCATATATAC | CATtacccttcatataTAC | 63.4 |
| 1530 | 1530_1 | ACATTACCCTTCATATATAC | ACAttacccttcatataTAC | 34.5 |
| 1531 | 1531_1 | TACATTACCCTTCATATATAC | TAcattacccttcatataTAC | 76.9 |
| 1532 | 1532_1 | CATTACCCTTCATATATA | CAttacccttcataTATA | 76.5 |
| 1533 | 1533_1 | TACATTACCCTTCATATATA | TACattacccttcatatATA | 36.5 |
| 1534 | 1534_1 | ATTACCCTTCATATATA | ATtacccttcataTATA | 78 |
| 1535 | 1535_1 | ACATTACCCTTCATATATA | ACattacccttcataTATA | 59.5 |
| 1536 | 1536_1 | CATTACCCTTCATATAT | CATtacccttcataTAT | 73.7 |
| 1537 | 1537_1 | ACATTACCCTTCATATAT | ACAttacccttcataTAT | 46.1 |
| 1538 | 1538_1 | TACATTACCCTTCATATAT | TACattacccttcataTAT | 36.9 |
| 1539 | 1539_1 | ACATTACCCTTCATATA | ACAttacccttcaTATA | 54.2 |
| 1540 | 1540_1 | TACATTACCCTTCATATA | TAcattacccttcaTATA | 71.5 |
| 1541 | 1541_1 | TACATTACCCTTCATAT | TACattacccttcaTAT | 34.5 |
| 1542 | 1542_1 | GATTCTTATACTTACTA | GATtcttatacttaCTA | 46.2 |
| 1543 | 1543_1 | TGATTCTTATACTTACT | TGattcttatactTACT | 45.7 |
| 1544 | 1544_1 | ATGATTCTTATACTTACT | ATGAttcttatacttaCT | 54 |
| 1545 | 1545_1 | GCCTCATTTTTACCTTT | GCctcatttttaccTTT | 82.6 |
| 1546 | 1546_1 | ACCAATCTTCTATTTTA | ACCAatcttctatttTA | 94.8 |
| 1547 | 1547_1 | CAACCAATCTTCTATTTTA | CAAccaatcttctatttTA | 90.3 |
| 1548 | 1548_1 | GCAACCAATCTTCTATTTT | GCAaccaatcttctattTT | 88.3 |
| 1549 | 1549_1 | GCAACCAATCTTCTATTT | GCAaccaatcttctaTTT | 85 |
| 1550 | 1550_1 | GCAACCAATCTTCTATT | GCaaccaatcttcTATT | 87.3 |
| 1551 | 1551_1 | TGCAACCAATCTTCTATT | TGCaaccaatcttctaTT | 90.2 |
| 1552 | 1552_1 | TAACTGCAACCAATCTT | TAactgcaaccaaTCTT | 88.2 |
| 1553 | 1553_1 | TGAATACAACACACATCA | TGAatacaacacacaTCA | 97.4 |
| 1554 | 1554_1 | ATGAATACAACACACATCA | ATGAatacaacacacatCA | 84.4 |
| 1555 | 1555_1 | TAAAAATATAACTACTCCT | TAaaaatataactacTCCT | 99.8 |
| 1556 | 1556_1 | GTAAAAATATAACTACTCC | GTaaaaatataactaCTCC | 93.7 |

TABLE 5-continued

| SEQID | CMPID | Oligonucleotide Base Sequence | Oligonucleotide compound | % of ATXN3 mRNA remaining |
|---|---|---|---|---|
| 1557 | 1557_1 | TCAACTGATACCCACAA | TCAactgatacccaCAA | 57.7 |
| 1558 | 1558_1 | TGTCTTAACATTTTCTT | TGTCttaacattttcTT | 63.1 |
| 1559 | 1559_1 | CCACTTCAAACTTTTAATTAA | CCActtcaaacttttaatTAA | 85 |
| 1560 | 1560_1 | CCACTTCAAACTTTTAATTA | CCACttcaaacttttaatTA | 84.9 |
| 1561 | 1561_1 | CCCACTTCAAACTTTTAATTA | CCcacttcaaacttttaaTTA | 88.7 |
| 1562 | 1562_1 | CCACTTCAAACTTTTAATT | CCACttcaaacttttaaTT | 79.1 |
| 1563 | 1563_1 | CCCACTTCAAACTTTTAATT | CCCacttcaaacttttaaTT | 86.2 |
| 1564 | 1564_1 | ACCCACTTCAAACTTTTAATT | ACCcacttcaaacttttaaTT | 100 |
| 1565 | 1565_1 | CCACTTCAAACTTTTAAT | CCACttcaaacttttaAT | 85.3 |
| 1566 | 1566_1 | ACCCACTTCAAACTTTTAAT | ACCcacttcaaacttttAAT | 88.8 |
| 1567 | 1567_1 | AACCCACTTCAAACTTTTAAT | AACCcacttcaaacttttaAT | 92.3 |
| 1568 | 1568_1 | CCCACTTCAAACTTTTAA | CCCacttcaaactttTAA | 79.9 |
| 1569 | 1569_1 | ACCCACTTCAAACTTTTAA | ACCcacttcaaactttTAA | 82.5 |
| 1570 | 1570_1 | CCCACTTCAAACTTTTA | CCCacttcaaactttTA | 79.6 |
| 1571 | 1571_1 | ACCCACTTCAAACTTTTA | ACCcacttcaaactTTA | 77.2 |
| 1572 | 1572_1 | AACCCACTTCAAACTTTTA | AACCcacttcaaactttTA | 86.2 |
| 1573 | 1573_1 | ACCCACTTCAAACTTTT | ACCCacttcaaactTT | 93.3 |
| 1574 | 1574_1 | AACCCACTTCAAACTTTT | AACCcacttcaaactTT | 82.7 |
| 1575 | 1575_1 | AACCCACTTCAAACTTT | AACCcacttcaaactTT | 85.8 |
| 1576 | 1576_1 | GGACTCTATTAATCAA | GGActctattaatCAA | 91.7 |
| 1577 | 1577_1 | GAATATTCTACTCTTCT | GAatattctactcTTCT | 95.3 |
| 1578 | 1578_1 | CTGTATTTACCAATTCAA | CTGtatttaccaattCAA | 90.8 |
| 1579 | 1579_1 | CTGTATTTACCAATTCA | CTGTatttaccaattCA | 88.7 |
| 1580 | 1580_1 | ACTGTATTTACCAATTCA | ACTGtatttaccaattCA | 97.3 |
| 1581 | 1581_1 | ACTGTATTTACCAATTC | ACTGtatttaccaatTC | 104 |
| 1582 | 1582_1 | CACTGTATTTACCAATT | CACTgtatttaccaaTT | 91.1 |
| 1583 | 1583_1 | TCACTGTATTTACCAAT | TCACtgtatttaccaAT | 98.6 |
| 1584 | 1584_1 | CCAACTACTTTACTTTTCAAA | CCaactacttttactttCAAA | 84.3 |
| 1585 | 1585_1 | CCAACTACTTTACTTTTCAA | CCaactactttactttTCAA | 80 |
| 1586 | 1586_1 | ACCAACTACTTTACTTTTCAA | ACcaactactttactttTCAA | 85.1 |
| 1585 | 1585_2 | CCAACTACTTTACTTTTCAA | CCAactactttactttCAA | 75.2 |
| 1587 | 1587_1 | CCAACTACTTTACTTTTCA | CCAactactttactttCA | 71.9 |
| 1588 | 1588_1 | TACCAACTACTTTACTTTTCA | TaccaactactttactTTCA | 82.8 |
| 1587 | 1587_2 | CCAACTACTTTACTTTTCA | CCAactactttacttTCA | 67.7 |
| 1589 | 1589_1 | ACCAACTACTTTACTTTTCA | ACcaactactttactttTCA | 84 |
| 1590 | 1590_1 | TACCAACTACTTTACTTTTC | TACcaactactttactTTC | 75.3 |
| 1591 | 1591_1 | GTACCAACTACTTTACTTT | GTACcaactactttactTT | 75.8 |
| 1592 | 1592_1 | GTACCAACTACTTTACTT | GTAccaactactttaCTT | 65.7 |

TABLE 5-continued

| SEQID | CMPID | Oligonucleotide Base Sequence | Oligonucleotide compound | % of ATXN3 mRNA remaining |
|---|---|---|---|---|
| 1593 | 1593_1 | GTACCAACTACTTTACT | GTACcaactactttaCT | 74.5 |
| 1594 | 1594_1 | TGTACCAACTACTTTACT | TGtaccaactacttTACT | 87.1 |
| 1595 | 1595_1 | TTGTACCAACTACTTTAC | TTGtaccaactacttTAC | 73.3 |
| 1596 | 1596_1 | GTACCAACTACTTTAC | GTAccaactacttTAC | 72.5 |
| 1597 | 1597_1 | TGTACCAACTACTTTAC | TGTaccaactacttTAC | 66 |
| 1598 | 1598_1 | TTGTACCAACTACTTTA | TTGTaccaactacttTA | 49.3 |
| 1599 | 1599_1 | ATTTCATTTTCTTTTAATA | ATTtcattttcttttaATA | 98.6 |
| 1599 | 1599_2 | ATTTCATTTTCTTTTAATA | ATTTcattttcttttaaTA | 90.7 |
| 1600 | 1600_1 | CCTAATTTCATTTTCTTTT | CCtaatttcattttcTTTT | 69.2 |
| 1601 | 1601_1 | TCCTAATTTCATTTTCTTT | TCctaatttcattttCTTT | 47 |
| 1602 | 1602_1 | TTCTTCATTATACCATCAAAT | TTCTtcattataccatcaaAT | 29.4 |
| 1603 | 1603_1 | TTTCTTCATTATACCATCAAA | TTTCttcattataccatcaAA | 24.1 |
| 1604 | 1604_1 | TTTTCTTCATTATACCATCAA | TTttcttcattataccaTCAA | 14.3 |
| 1605 | 1605_1 | TCTTCATTATACCATCAA | TCttcattataccaTCAA | 5.02 |
| 1606 | 1606_1 | TTTCTTCATTATACCATCAA | TTtcttcattataccaTCAA | 21.2 |
| 1607 | 1607_1 | TTCTTCATTATACCATCAA | TTCttcattataccatCAA | 5.83 |
| 1608 | 1608_1 | ATATTTTCTTCATTATACCAT | AtattttcttcattataCCAT | 76.1 |
| 1609 | 1609_1 | ATATTTTCTTCATTATACCA | AtattttcttcattataCCA | 40.2 |
| 1610 | 1610_1 | AATATTTTCTTCATTATACCA | AAtattttcttcattataCCA | 37 |
| 1611 | 1611_1 | AAATATTTTCTTCATTATACC | AAatattttcttcattaTACC | 23.4 |
| 1612 | 1612_1 | ATATTTTCTTCATTATACC | ATattttcttcattaTACC | 14.2 |
| 1613 | 1613_1 | AATATTTTCTTCATTATACC | AATAttttcttcattataCC | 68 |
| 1614 | 1614_1 | TAAATATTTTCTTCATTATA | TAaatattttcttcatTATA | 96.8 |
| 1615 | 1615_1 | TTTTCCTTCATCTACTTCT | TTTtccttcatctacttCT | 42.8 |
| 1616 | 1616_1 | ATTTTCCTTCATCTACTTCT | ATttteccttcatctacttCT | 76 |
| 1617 | 1617_1 | AATTTTCCTTCATCTACTTC | AATTttccttcatctactTC | 54.9 |
| 1618 | 1618_1 | AGAATTTTCCTTCATCTA | AgaattttccttcaTCTA | 58 |
| 1619 | 1619_1 | CAGAATTTTCCTTCATCT | CAgaattttccttcATCT | 23.5 |
| 1620 | 1620_1 | TCAGAATTTTCCTTCATC | TCAgaattttccttcaTC | 29.7 |
| 1621 | 1621_1 | CTAGAAATATCTCACATT | CTAGaaatatctcacaTT | 64.6 |
| 1622 | 1622_1 | CTAGAAATATCTCACAT | CTAgaaatatctcaCAT | 75.5 |
| 1623 | 1623_1 | ACTAGAAATATCTCACA | ACTAgaaatatctcaCA | 53.2 |
| 1624 | 1624_1 | ATTAGCCATTAATCTAT | ATtagccattaatCTAT | 71.9 |
| 1625 | 1625_1 | TTGTTACAAAATAATCCA | TTgttacaaaataaTCCA | 12 |
| 1625 | 1625_2 | TTGTTACAAAATAATCCA | TTGttacaaaataatCCA | 23.8 |
| 1626 | 1626_1 | TTATTTTTACATTAACTA | TTAtttttacattaaCTA | 92.1 |
| 1627 | 1627_1 | TGCCAAAATACTAACATCA | TGCcaaaatactaacaTCA | 32 |

TABLE 5-continued

| SEQID | CMPID | Oligonucleotide Base Sequence | Oligonucleotide compound | % of ATXN3 mRNA remaining |
|---|---|---|---|---|
| 1628 | 1628_1 | GCCAAAATACTAACATCA | GCCaaaatactaacaTCA | 27.8 |
| 1629 | 1629_1 | TGCCAAAATACTAACATC | TGCCaaaatactaacaTC | 61.5 |
| 1630 | 1630_1 | GAGTACAACACTTACA | GAGTacaacacttaCA | 31.8 |
| 1631 | 1631_1 | CACATCCATTCATTTTAT | CACatccattcatttTAT | 30.6 |
| 1632 | 1632_1 | CCACATCCATTCATTTTAT | CCAcatccattcattttAT | 21.7 |
| 1633 | 1633_1 | CCACATCCATTCATTTTA | CCacatccattcattTTA | 20 |
| 1634 | 1634_1 | TATGCCACATCCATTCAT | TatgccacatccattCAT | 47 |
| 1635 | 1635_1 | TTATGCCACATCCATTCA | TtatgccacatccaTTCA | 20.7 |
| 1636 | 1636_1 | TATGCCACATCCATTCA | TAtgccacatccattCA | 43.3 |
| 1637 | 1637_1 | TTATGCCACATCCATTC | TtatgccacatccATTC | 19.5 |
| 1638 | 1638_1 | ATTATGCCACATCCATT | ATtatgccacatcCATT | 25.1 |
| 1639 | 1639_1 | AGTTTCATATTTTTAATC | AGTttcatattttaATC | 65.9 |
| 1640 | 1640_1 | ATCACTGCACACTTTCC | ATCactgcacactttCC | 12.9 |
| 1641 | 1641_1 | AAGCTCTTTCCAAATTCT | AAGCtctttccaaattCT | 34.6 |
| 1642 | 1642_1 | TAGTTCTTAACTCTTCTC | TagttcttaactctTCTC | 19.2 |
| 1643 | 1643_1 | TTAGTTCTTAACTCTTC | TTAGttcttaactctTC | 18 |
| 1644 | 1644_1 | AGCTTCAAATACTCAAA | AGCTtcaaatactcaAA | 74.5 |
| 1645 | 1645_1 | TTTCAAAGCCACACCTA | TttcaaagccacaCCTA | 66.9 |
| 1646 | 1646_1 | AATATCCTCATTACCCATT | AATatcctcattacccaTT | 52.3 |
| 1647 | 1647_1 | TATCCTCATTACCCATT | TAtcctcattaccCATT | 53.4 |
| 1647 | 1647_2 | TATCCTCATTACCCATT | TATCctcattacccaTT | 22.3 |
| 1648 | 1648_1 | ATATCCTCATTACCCATT | ATatcctcattacccATT | 55.8 |
| 1649 | 1649_1 | AATATCCTCATTACCCAT | AAatatcctcattacCCAT | 46.1 |
| 1650 | 1650_1 | TAATATCCTCATTACCCAT | TAAatatcctcattaccCAT | 58.3 |
| 1651 | 1651_1 | TTAATATCCTCATTACCCAT | TTaatatcctcattaccCAT | 61.8 |
| 1652 | 1652_1 | ATATCCTCATTACCCAT | ATAtcctcattaccCAT | 56.2 |
| 1653 | 1653_1 | AATATCCTCATTACCCA | AAatatcctcattaCCCA | 49.7 |
| 1654 | 1654_1 | TAATATCCTCATTACCCA | TAAtatcctcattaccCA | 45.6 |
| 1655 | 1655_1 | TTTAATATCCTCATTACCCA | TttaatatcctcattacCCA | 67.5 |
| 1656 | 1656_1 | TTAATATCCTCATTACCCA | TTaatatcctcattacCCA | 36 |
| 1656 | 1656_2 | TTAATATCCTCATTACCCA | TTAAtatcctcattaccCA | 57.9 |
| 1654 | 1654_2 | TAATATCCTCATTACCCA | TAAtatcctcattacCCA | 40 |
| 1653 | 1653_2 | AATATCCTCATTACCCA | AAtatcctcattacCCA | 44.8 |
| 1657 | 1657_1 | ATTTAATATCCTCATTACCC | AtttaatatcctcattaCCC | 59.9 |
| 1658 | 1658_1 | TAATATCCTCATTACCC | TAAtatcctcattacCC | 32.9 |
| 1659 | 1659_1 | TTAATATCCTCATTACCC | TTAAtatcctcattacCC | 42 |
| 1660 | 1660_1 | TTTAATATCCTCATTACCC | TttaatatcctcattACCC | 41.1 |
| 1661 | 1661_1 | AATTTAATATCCTCATTACCC | AatttaatatcctcattaCCC | 61 |

TABLE 5-continued

| SEQID | CMPID | Oligonucleotide Base Sequence | Oligonucleotide compound | % of ATXN3 mRNA remaining |
|---|---|---|---|---|
| 1662 | 1662_1 | TTTAATATCCTCATTACC | TTTAatatcctcattaCC | 60.6 |
| 1663 | 1663_1 | AATTTAATATCCTCATTACC | AAtttaatatcctcatTACC | 58.8 |
| 1664 | 1664_1 | TTAATATCCTCATTACC | TTaatatcctcatTACC | 42.3 |
| 1665 | 1665_1 | AAATTTAATATCCTCATTACC | AAatttaatatcctcatTACC | 55.9 |
| 1666 | 1666_1 | ATTTAATATCCTCATTACC | ATttaatatcctcatTACC | 55.5 |
| 1667 | 1667_1 | TAAATTTAATATCCTCATTAC | TAaatttaatatcctcaTTAC | 78 |
| 1668 | 1668_1 | TTAAATTTAATATCCTCATTA | TTAaatttaatatcctcaTTA | 95.2 |
| 1669 | 1669_1 | CTTAAATTTAATATCCTCATT | CTtaaatttaatatcctCATT | 73.2 |
| 1670 | 1670_1 | TCTTAAATTTAATATCCTCAT | TCttaaatttaatatccTCAT | 46.8 |
| 1671 | 1671_1 | TCTTAAATTTAATATCCTCA | TCttaaatttaatatcCTCA | 29.8 |
| 1672 | 1672_1 | TTCTTAAATTTAATATCCTCA | TTCttaaatttaatatccTCA | 35 |
| 1673 | 1673_1 | TTCTTAAATTTAATATCCTC | TTcttaaatttaatatCCTC | 36.2 |
| 1674 | 1674_1 | TCTTAAATTTAATATCCTC | TCttaaatttaatatCCTC | 25.1 |
| 1675 | 1675_1 | TTCTTAAATTTAATATCCT | TTCttaaatttaatatCCT | 46.9 |
| 1676 | 1676_1 | TCTTAAATTTAATATCCT | TCttaaatttaataTCCT | 50.9 |
| 1677 | 1677_1 | AATAGCCTTTATTCTAC | AAtagcctttattCTAC | 33.6 |
| 1678 | 1678_1 | CAGCAACAATTATTAATA | CAGCaacaattattaaTA | 70.5 |
| 1679 | 1679_1 | CCAGCAACAATTATTAAT | CCAGcaacaattattaAT | 64.2 |
| 1680 | 1680_1 | ACCAGCAACAATTATTAA | ACCagcaacaattatTAA | 20.5 |
| 1680 | 1680_2 | ACCAGCAACAATTATTAA | ACCAgcaacaattattAA | 39.7 |
| 1681 | 1681_1 | ACCAGCAACAATTATTA | ACCAgcaacaattatTA | 39.4 |
| 1682 | 1682_1 | TACCAGCAACAATTATT | TACCagcaacaattaTT | 26.4 |
| 1683 | 1683_1 | CCCCAAATCTAAAACACTTC | CCcccaaatctaaaacacTTC | 79.4 |
| 1684 | 1684_1 | AACCCCAAATCTAAAACACTT | AACCcccaaatctaaaacacTT | 82 |
| 1685 | 1685_1 | CCCCAAATCTAAAACACTT | CCCcccaaatctaaaacacTT | 86.4 |
| 1686 | 1686_1 | AACCCCAAATCTAAAACACT | AACCcccaaatctaaaacaCT | 75.2 |
| 1687 | 1687_1 | ACCCCAAATCTAAAACACT | ACccccaaatctaaaaCACT | 72.5 |
| 1688 | 1688_1 | ACCCCAAATCTAAAACAC | ACCcccaaatctaaaaCAC | 80.9 |
| 1689 | 1689_1 | GCAAATATTCACAAATCCT | GCAaatattcacaaatCCT | 20.7 |
| 1689 | 1689_2 | GCAAATATTCACAAATCCT | GCaaatattcacaaaTCCT | 29.3 |
| 1690 | 1690_1 | ACTATTTAACACACATTATCA | ACTatttaacacacattaTCA | 36.6 |
| 1691 | 1691_1 | CTATTTAACACACATTATCA | CTAtttaacacacattaTCA | 49.6 |
| 1692 | 1692_1 | TACTATTTAACACACATTATC | TACTatttaacacacattaTC | 52.4 |
| 1693 | 1693_1 | ACTATTTAACACACATTATC | ACTAtttaacacacattaTC | 51.8 |
| 1694 | 1694_1 | TACTATTTAACACACATTAT | TACtatttaacacacatTAT | 91.1 |
| 1695 | 1695_1 | CTACTATTTAACACACATTAT | CTActatttaacacacatTAT | 72.7 |
| 1696 | 1696_1 | CTACTATTTAACACACATTA | CTACtatttaacacacatTA | 47.4 |

TABLE 5-continued

| SEQID | CMPID | Oligonucleotide Base Sequence | Oligonucleotide compound | % of ATXN3 mRNA remaining |
|---|---|---|---|---|
| 1697 | 1697_1 | ACTACTATTTAACACACATTA | ACTActatttaacacacatTA | 38.3 |
| 1698 | 1698_1 | CTACTATTTAACACACATT | CTACtatttaacacacaTT | 41.6 |
| 1699 | 1699_1 | ACTACTATTTAACACACATT | ACtactatttaacaCATT | 40.3 |
| 1700 | 1700_1 | ACTACTATTTAACACACAT | ACTactatttaacacaCAT | 36.8 |
| 1701 | 1701_1 | CTACTATTTAACACACA | CTACtatttaacacaCA | 45.9 |
| 1702 | 1702_1 | ACTACTATTTAACACACA | ACTactatttaacacaCA | 32.6 |
| 1703 | 1703_1 | TATAGACCCTTAATATT | TATAgacccttaataTT | 41.4 |
| 1704 | 1704_1 | TTATAGACCCTTAATAT | TTAtagacccttaaTAT | 68.5 |
| 1705 | 1705_1 | CATCACAAAATAACCTATCAT | CAtcacaaaataacctaTCAT | 86.8 |
| 1706 | 1706_1 | TCATCACAAAATAACCTATCA | TCAtcacaaaataacctaTCA | 67.4 |
| 1707 | 1707_1 | TTCATCACAAAATAACCTATC | TTCAtcacaaaataacctaTC | 49 |
| 1708 | 1708_1 | TTCATCACAAAATAACCTA | TTcatcacaaaataaCCTA | 76.4 |
| 1709 | 1709_1 | TTTCATCACAAAATAACCTA | TTtcatcacaaaataaCCTA | 88.6 |
| 1710 | 1710_1 | TCATCACAAAATAACCTA | TCatcacaaaataaCCTA | 59.2 |
| 1711 | 1711_1 | TTTTCATCACAAAATAACCTA | TTtttcatcacaaaataaCCTA | 86.1 |
| 1712 | 1712_1 | ATTTTCATCACAAAATAACCT | ATTttcatcacaaaataaCCT | 64.8 |
| 1713 | 1713_1 | TATTTTCATCACAAAATAACC | TATTttcatcacaaaataaCC | 76.9 |
| 1713 | 1713_2 | TATTTTCATCACAAAATAACC | TATTttcatcaCaaaataaCC | 56 |
| 1714 | 1714_1 | GTATTTTCATCACAAAATA | GTATtttcatcacaaaaTA | 47 |
| 1715 | 1715_1 | TTACCTAGATCACTCC | TtacctagatcaCTCC | 73.1 |
| 1716 | 1716_1 | CTTACCTAGATCACTC | CTTacctagatcaCTC | 81.5 |
| 1717 | 1717_1 | CCTTACCTAGATCACT | CCTtacctagatcaCT | 95.9 |
| 1718 | 1718_1 | TAACTGCTCCTTAATCC | TAActgctccttaatCC | 34.8 |
| 1719 | 1719_1 | TCTAGCAATCCTCTCCT | TCtagcaatcctctcCT | 64.2 |
| 1720 | 1720_1 | TTCTAGCAATCCTCTCC | TtctagcaatcctcTCC | 70.4 |
| 1721 | 1721_1 | TTTTCACCTACTAATATTCAT | TTtttcacctactaatatTCAT | 55.3 |
| 1722 | 1722_1 | TTTCACCTACTAATATTCAT | TTtcacctactaatatTCAT | 66.2 |
| 1723 | 1723_1 | TTCACCTACTAATATTCAT | TTCacctactaatattCAT | 17.2 |
| 1724 | 1724_1 | TCACCTACTAATATTCAT | TCAcctactaatattCAT | 23.5 |
| 1725 | 1725_1 | TCACCTACTAATATTCA | TCAcctactaatatTCA | 21.1 |
| 1726 | 1726_1 | TTTCACCTACTAATATTCA | TTTCacctactaatattCA | 16.7 |
| 1727 | 1727_1 | TTTTCACCTACTAATATTCA | TTttcacctactaataTTCA | 31.3 |
| 1728 | 1728_1 | TTTTTCACCTACTAATATTCA | TTtttcacctactaataTTCA | 45.3 |
| 1729 | 1729_1 | TTCACCTACTAATATTCA | TTCAcctactaatattCA | 24.7 |
| 1730 | 1730_1 | ATTTTTCACCTACTAATATTC | ATTtttcacctactaataTTC | 48.5 |
| 1731 | 1731_1 | TTTTTCACCTACTAATATTC | TTTttcacctactaataTTC | 31.5 |
| 1732 | 1732_1 | TATTTTTCACCTACTAATATT | TAttttcacctactaaTATT | 90.2 |
| 1733 | 1733_1 | TATTTTTCACCTACTAATAT | TATttttcacctactaaTAT | 89.1 |

TABLE 5-continued

| SEQID | CMPID | Oligonucleotide Base Sequence | Oligonucleotide compound | % of ATXN3 mRNA remaining |
|---|---|---|---|---|
| 1734 | 1734_1 | TTATTTTTCACCTACTAATAT | TTAttttttcacctactaaTAT | 86.1 |
| 1735 | 1735_1 | TTATTTTTCACCTACTAATA | TTATttttcacctactaaTA | 52.9 |
| 1736 | 1736_1 | TATTTTTCACCTACTAATA | TATTtttcacctactaaTA | 54.9 |
| 1737 | 1737_1 | TTTATTTTTCACCTACTAATA | TTTAttttttcacctactaaTA | 52 |
| 1738 | 1738_1 | TTTATTTTTCACCTACTAA | TTtattttttcacctaCTAA | 51.2 |
| 1739 | 1739_1 | TTTATTTTTCACCTACTA | TTTattttttcacctaCTA | 19 |
| 1740 | 1740_1 | CTCAACTTCTACTACTAATT | CTCAacttctactactaaTT | 19.7 |
| 1741 | 1741_1 | TCTCAACTTCTACTACTAATT | TCTCaacttctactactaaTT | 25.8 |
| 1742 | 1742_1 | CTCTCAACTTCTACTACTAAT | CTCtcaacttctactactAAT | 43 |
| 1743 | 1743_1 | CTCAACTTCTACTACTAAT | CTCAacttctactactaAT | 20.1 |
| 1744 | 1744_1 | TCTCAACTTCTACTACTAAT | TCTCaacttctactactaAT | 22.8 |
| 1745 | 1745_1 | TCTCTCAACTTCTACTACTAA | TCtctcaacttctactacTAA | 58.4 |
| 1746 | 1746_1 | CTCAACTTCTACTACTAA | CTcaacttctactaCTAA | 47.3 |
| 1747 | 1747_1 | TCTCAACTTCTACTACTAA | TCtcaacttctactaCTAA | 56.3 |
| 1748 | 1748_1 | CTCAACTTCTACTACTA | CTCaacttctactaCTA | 10.7 |
| 1749 | 1749_1 | TTCTCTCAACTTCTACTACTA | TtctctcaacttctactaCTA | 79.1 |
| 1750 | 1750_1 | TCTCTCAACTTCTACTACTA | TCtctcaacttctactacTA | 61.2 |
| 1751 | 1751_1 | TCTCAACTTCTACTACTA | TCtcaacttctactaCTA | 66.8 |
| 1752 | 1752_1 | CTCTCAACTTCTACTACTA | CtctcaacttctactACTA | 61.7 |
| 1753 | 1753_1 | CTCTCAACTTCTACTACT | CTCtcaacttctactaCT | 37.9 |
| 1754 | 1754_1 | TCTCAACTTCTACTACT | TCtcaacttctacTACT | 51.1 |
| 1755 | 1755_1 | TCTCTCAACTTCTACTACT | TCtctcaacttctactACT | 44.2 |
| 1756 | 1756_1 | TTTCTCTCAACTTCTACTACT | TTtctctcaacttctactACT | 65.7 |
| 1757 | 1757_1 | TTCTCTCAACTTCTACTACT | TTCtctcaacttctactaCT | 33.5 |
| 1758 | 1758_1 | TTTCTCTCAACTTCTACTAC | TTtctctcaacttctacTAC | 67.9 |
| 1759 | 1759_1 | CTCTCAACTTCTACTAC | CTCtcaacttctacTAC | 34.1 |
| 1760 | 1760_1 | TTCTCTCAACTTCTACTAC | TtctctcaacttctaCTAC | 63.8 |
| 1761 | 1761_1 | TTTTCTCTCAACTTCTACTAC | TTTTctctcaacttctactAC | 20.6 |
| 1762 | 1762_1 | TCTCTCAACTTCTACTAC | TCtctcaacttctacTAC | 49.7 |
| 1763 | 1763_1 | TTTCTCTCAACTTCTACTA | TTtctctcaacttctaCTA | 60.2 |
| 1764 | 1764_1 | TTTTCTCTCAACTTCTACTA | TtttctctcaacttctACTA | 52.2 |
| 1765 | 1765_1 | TTTTTCTCTCAACTTCTACTA | TTTttctctcaacttctacTA | 40.2 |
| 1766 | 1766_1 | TCTCTCAACTTCTACTA | TCtctcaacttctaCTA | 47.5 |
| 1767 | 1767_1 | TTCTCTCAACTTCTACTA | TTCtctcaacttctacTA | 35.1 |
| 1768 | 1768_1 | TTTCTCTCAACTTCTACT | TTTCtctcaacttctaCT | 28.6 |
| 1769 | 1769_1 | TTTTCTCTCAACTTCTACT | TTTtctctcaacttctaCT | 44.1 |
| 1770 | 1770_1 | CTTTTTCTCTCAACTTCTACT | CttttttctctcaacttctaCT | 99.8 |

TABLE 5-continued

| SEQID | CMPID | Oligonucleotide Base Sequence | Oligonucleotide compound | % of ATXN3 mRNA remaining |
|---|---|---|---|---|
| 1771 | 1771_1 | TTTTTCTCTCAACTTCTACT | TTTttctctcaacttctaCT | 43.7 |
| 1772 | 1772_1 | CTTTTTCTCTCAACTTCTAC | CTTttctctcaacttctAC | 36.2 |
| 1773 | 1773_1 | ACTTTTTCTCTCAACTTCTAC | ACTttttctctcaacttctAC | 35.6 |
| 1774 | 1774_1 | TTTTCTCTCAACTTCTAC | TtttctctcaacttCTAC | 38.6 |
| 1775 | 1775_1 | TTTTTCTCTCAACTTCTAC | TttttctctcaacttCTAC | 42.1 |
| 1776 | 1776_1 | CTTTTTCTCTCAACTTCTA | CTttttctctcaacttCTA | 41.2 |
| 1777 | 1777_1 | TACTTTTTCTCTCAACTTCTA | TactttttctctcaacttCTA | 69.4 |
| 1778 | 1778_1 | ACTTTTTCTCTCAACTTCTA | ActttttctctcaacttCTA | 66.2 |
| 1779 | 1779_1 | TTTTTCTCTCAACTTCTA | TttttctctcaactTCTA | 35.5 |
| 1780 | 1780_1 | TACTTTTTCTCTCAACTTCT | TActttttctctcaacttCT | 65 |
| 1781 | 1781_1 | TTACTTTTTCTCTCAACTTCT | TtactttttctctcaactTCT | 62.1 |
| 1782 | 1782_1 | TTACTTTTTCTCTCAACTTC | TTActttttctctcaactTC | 38.9 |
| 1783 | 1783_1 | TACTTTTTCTCTCAACTTC | TACtttttctctcaactTC | 34 |
| 1784 | 1784_1 | ACTTTTTCTCTCAACTTC | ActttttctctcaaCTTC | 19.7 |
| 1785 | 1785_1 | TTACTTTTTCTCTCAACTT | TTActttttctctcaaCTT | 22 |
| 1786 | 1786_1 | TACTTTTTCTCTCAACTT | TACtttttctctcaaCTT | 22.3 |
| 1787 | 1787_1 | TTACTTTTTCTCTCAACT | TTActttttctctcaaCT | 11.6 |
| 1788 | 1788_1 | GTTACTTTTTCTCTCAACT | GTtactttttctctcAACT | 43.2 |
| 1789 | 1789_1 | GTTACTTTTTCTCTCAAC | GTtactttttctctCAAC | 29 |
| 1790 | 1790_1 | GTTACTTTTTCTCTCAA | GTtactttttctcTCAA | 5.53 |
| 1791 | 1791_1 | AGTTACTTTTTCTCTCAA | AGTtactttttctctCAA | 6.5 |
| 1792 | 1792_1 | CTTTTACATTCCCATTAACA | CTTTtacattcccattaaCA | 24.5 |
| 1793 | 1793_1 | CACTTTTACATTCCCATTAAC | CACttttacattcccattaAC | 25.3 |
| 1794 | 1794_1 | CTTTTACATTCCCATTAAC | CTtttacattcccatTAAC | 21.5 |
| 1795 | 1795_1 | ACTTTTACATTCCCATTAAC | ACttttacattcccatTAAC | 23 |
| 1796 | 1796_1 | ACTTTTACATTCCCATTAA | ACttttacattcccaTTAA | 30 |
| 1797 | 1797_1 | CTTTTACATTCCCATTAA | CTtttacattcccaTTAA | 27.4 |
| 1798 | 1798_1 | CACTTTTACATTCCCATTAA | CActtttacattcccaTTAA | 28 |
| 1798 | 1798_2 | CACTTTTACATTCCCATTAA | CACttttacattcccatTAA | 15.9 |
| 1799 | 1799_1 | TACACTTTTACATTCCCATTA | TAcacttttacattcccatTA | 52.2 |
| 1800 | 1800_1 | ACTTTTACATTCCCATTA | ACTtttacattcccaTTA | 13.1 |
| 1801 | 1801_1 | CACTTTTACATTCCCATTA | CActtttacattcccATTA | 15.7 |
| 1802 | 1802_1 | ACACTTTTACATTCCCATTA | ACactttacattcccaTTA | 19.1 |
| 1802 | 1802_2 | ACACTTTTACATTCCCATTA | ACactttacattcccatTA | 9.66 |
| 1803 | 1803_1 | CACTTTTACATTCCCATT | CActtttacattccCATT | 10.2 |
| 1804 | 1804_1 | TACACTTTTACATTCCCATT | TACacttttacattcccaTT | 10.3 |
| 1805 | 1805_1 | ACACTTTTACATTCCCATT | ACActtttacattcccaTT | 4.51 |
| 1805 | 1805_2 | ACACTTTTACATTCCCATT | ACacttttacattccCATT | 6.8 |

TABLE 5-continued

| SEQID | CMPID | Oligonucleotide Base Sequence | Oligonucleotide compound | % of ATXN3 mRNA remaining |
|---|---|---|---|---|
| 1806 | 1806_1 | TACACTTTTACATTCCCAT | TACacttttacattccCAT | 3.53 |
| 1806 | 1806_2 | TACACTTTTACATTCCCAT | TACActtttacattcccAT | 4.79 |
| 1807 | 1807_1 | TACACTTTTACATTCCCA | TACacttttacattccCA | 6.35 |
| 1808 | 1808_1 | GTACACTTTTACATTCCCA | GtacacttttacattcCCA | 3 |
| 1808 | 1808_2 | GTACACTTTTACATTCCCA | GTacacttttacattccCA | 16.3 |
| 1809 | 1809_1 | GTACACTTTTACATTCCC | GTAcacttttacattcCC | 4.33 |
| 1810 | 1810_1 | TACACTTTTACATTCCC | TACacttttacattcCC | 3.26 |
| 1811 | 1811_1 | TGTACACTTTTACATTCCC | TGtacacttttacattcCC | 12.3 |
| 1809 | 1809_2 | GTACACTTTTACATTCCC | GtacacttttacattCCC | 2.49 |
| 1812 | 1812_1 | TGTACACTTTTACATTCC | TGtacacttttacatTCC | 2.47 |
| 1813 | 1813_1 | CTGTACACTTTTACATTC | CTGtacacttttacaTTC | 1.89 |
| 1814 | 1814_1 | ATCTTATTTACATCTTCC | ATcttatttacatcTTCC | 5.41 |
| 1815 | 1815_1 | GAATCTTATTTACATCTTC | GAatcttatttacatCTTC | 25.8 |
| 1816 | 1816_1 | GAATCTTATTTACATCTT | GAatcttatttacaTCTT | 19.1 |
| 1817 | 1817_1 | TGAATCTTATTTACATCT | TGAatcttatttacaTCT | 41.3 |
| 1818 | 1818_1 | ATTCAGCTTTTTCAATC | ATTCagcttttttcaaTC | 16.8 |
| 1819 | 1819_1 | TTAATTTTCCCTTCACTCCT | TtaattttcccttcactcCT | 85.8 |
| 1820 | 1820_1 | TTAATTTTCCCTTCACTCC | TtaattttcccttcactCC | 85.8 |
| 1821 | 1821_1 | TTAATTTTCCCTTCACTC | TtaattttcccttcACTC | 51 |
| 1822 | 1822_1 | GTTAATTTTCCCTTCACTC | GttaattttcccttcACTC | 27.2 |
| 1823 | 1823_1 | CAAAATTACTTCTTTTATCAT | CAaaattacttcttttaTCAT | 86.7 |
| 1823 | 1823_2 | CAAAATTACTTCTTTTATCAT | CAaaattacTtatttaTCAT | 51.5 |
| 1824 | 1824_1 | CCAAAATTACTTCTTTTATCA | CCAaaattacttcttttaTCA | 31.3 |
| 1824 | 1824_2 | CCAAAATTACTTCTTTTATCA | CCaaaattacttcttttATCA | 36 |
| 1825 | 1825_1 | TCCAAAATTACTTCTTTTATC | TCcaaaattacttctttTATC | 40.9 |
| 1826 | 1826_1 | TCCAAAATTACTTCTTTTAT | TCCaaaattacttctttTAT | 50.2 |
| 1827 | 1827_1 | CCAAAATTACTTCTTTTAT | CCAaaattacttctttTAT | 70 |
| 1828 | 1828_1 | TTCCAAAATTACTTCTTTTAT | TTCcaaaattacttctttTAT | 64.9 |
| 1829 | 1829_1 | TCCAAAATTACTTCTTTTA | TCCAaaattacttctttTA | 36.9 |
| 1830 | 1830_1 | TTCCAAAATTACTTCTTTTA | TTCCaaaattacttctttTA | 52.2 |
| 1831 | 1831_1 | GTTCCAAAATTACTTCTTT | GTTCcaaaattacttctTT | 54.8 |
| 1832 | 1832_1 | GTTCCAAAATTACTTCTT | GTccaaaattactTCTT | 12.5 |
| 1833 | 1833_1 | TGTTCCAAAATTACTTCT | TGTtccaaaattactTCT | 20.1 |
| 1834 | 1834_1 | ATGTTCCAAAATTACTTC | ATGTtccaaaattactTC | 23.8 |
| 1835 | 1835_1 | CATATTTTACTCTTTTATT | CATAtttactcttttaTT | 90.6 |
| 1836 | 1836_1 | CCATATTTTACTCTTTTAT | CCATatttactcttttAT | 35.4 |
| 1836 | 1836_2 | CCATATTTTACTCTTTTAT | CCAtatttactcttttTAT | 60.8 |

TABLE 5-continued

| SEQID | CMPID | Oligonucleotide Base Sequence | Oligonucleotide compound | % of ATXN3 mRNA remaining |
|---|---|---|---|---|
| 1837 | 1837_1 | CCCATATTTTACTCTTTTAT | CccatattttactctttTTAT | 75.8 |
| 1838 | 1838_1 | CATATTTTACTCTTTTAT | CATattttactcttttTAT | 83.2 |
| 1839 | 1839_1 | CCCATATTTTACTCTTTTA | CCcatattttactcttttTA | 81.1 |
| 1840 | 1840_1 | CCATATTTTACTCTTTTA | CCatattttactcttTTTA | 24.7 |
| 1841 | 1841_1 | ACCCATATTTTACTCTTTTA | AcccatattttactcttTTTA | 59 |
| 1842 | 1842_1 | CCATATTTTACTCTTTT | CCATattttactcttTT | 21.6 |
| 1843 | 1843_1 | CCCATATTTTACTCTTTT | CCcatattttactcttTTT | 77.2 |
| 1844 | 1844_1 | ACCCATATTTTACTCTTTT | AcccatattttactctTTTT | 97.4 |
| 1845 | 1845_1 | TACCCATATTTTACTCTTTT | TAcccatattttactcttTTT | 58.6 |
| 1846 | 1846_1 | TACCCATATTTTACTCTTT | TACccatattttactctTTT | 20.4 |
| 1847 | 1847_1 | CCCATATTTTACTCTTT | CCCatattttactcttTT | 93.2 |
| 1848 | 1848_1 | ACCCATATTTTACTCTTT | ACCcatattttactcttTT | 21.8 |
| 1846 | 1846_2 | TACCCATATTTTACTCTTT | TAcccatattttactcTTTT | 22.5 |
| 1849 | 1849_1 | TTACCCATATTTTACTCTTTT | TTAcccatattttactcttTT | 41.4 |
| 1850 | 1850_1 | TACCCATATTTTACTCTTT | TAcccatattttactCTTT | 18.9 |
| 1851 | 1851_1 | ACCCATATTTTACTCTTT | ACCcatattttactcTTT | 13.4 |
| 1852 | 1852_1 | TTACCCATATTTTACTCTTT | TTacccatattttactCTTT | 14.5 |
| 1853 | 1853_1 | TTTACCCATATTTTACTCTTT | TTTacccatattttactcTTT | 22.2 |
| 1852 | 1852_2 | TTACCCATATTTTACTCTTT | TTAcccatattttactctTT | 16.7 |
| 1853 | 1853_2 | TTTACCCATATTTTACTCTTT | TTTAcccatattttactctTT | 16 |
| 1854 | 1854_1 | TTACCCATATTTTACTCTT | TTAcccatattttactCTT | 14 |
| 1855 | 1855_1 | TTTACCCATATTTTACTCTT | TTtacccatattttacTCTT | 14.9 |
| 1856 | 1856_1 | ACCCATATTTTACTCTT | ACCcatattttactCTT | 8.02 |
| 1857 | 1857_1 | TACCCATATTTTACTCTT | TACccatattttactCTT | 16.7 |
| 1858 | 1858_1 | TACCCATATTTTACTCT | TACccatattttacTCT | 22.3 |
| 1859 | 1859_1 | TTACCCATATTTTACTCT | TTACccatattttactCT | 15.2 |
| 1860 | 1860_1 | TTTACCCATATTTTACTCT | TTTAcccatattttactCT | 11.8 |
| 1861 | 1861_1 | TTACCCATATTTTACTC | TTAcccatattttaCTC | 24.4 |
| 1862 | 1862_1 | TTTACCCATATTTTACTC | TTTacccatattttaCTC | 14 |
| 1863 | 1863_1 | GTTACCCATATTTTACTC | GTttacccatattttaCTC | 12.2 |
| 1864 | 1864_1 | GTTTACCCATATTTTACT | GTttacccatattttTACT | 24.9 |
| 1865 | 1865_1 | TGTTTACCCATATTTTAC | TGTttacccatatttTAC | 13.1 |
| 1866 | 1866_1 | GTTTACCCATATTTAC | GTttacccatattTTAC | 13.2 |
| 1867 | 1867_1 | TGTTTACCCATATTTTA | TGTttacccatattTTA | 6.69 |
| 1868 | 1868_1 | TTCTTGCTTCAACCATC | TtcttgcttcaacCATC | 13.6 |
| 1869 | 1869_1 | GTTACCTCCCTTTATAT | GTtacctcccttatAT | 60.9 |
| 1870 | 1870_1 | GGTTACCTCCCTTTAT | GgttacctcccTTAT | 39 |
| 1871 | 1871_1 | AGGTTACCTCCCTTTA | AggttacctcccTTTA | 35.4 |

TABLE 5-continued

| SEQID | CMPID | Oligonucleotide Base Sequence | Oligonucleotide compound | % of ATXN3 mRNA remaining |
|---|---|---|---|---|
| 1872 | 1872_1 | ATGTTCTCTATCTCTATA | ATGttctctatctctATA | 53.3 |
| 1873 | 1873_1 | TATGTTCTCTATCTCTA | TAtgttctctatctCTA | 73.4 |
| 1874 | 1874_1 | AGATCAAACTAAAACCT | AGAtcaaactaaaaCCT | 88.7 |
| 1875 | 1875_1 | TGCCCAATTTCACCCAA | TGcccaatttcacccAA | 30.3 |
| 1876 | 1876_1 | TTTGCCCAATTTCACCC | Tttgcccaatttcacc | 53.3 |
| 1877 | 1877_1 | TTTTGCCCAATTTCACC | TTttgcccaatttcaCC | 57.8 |
| 1878 | 1878_1 | TGTATATCAACAATTCAT | TGTatatcaacaattCAT | 20.8 |
| 1879 | 1879_1 | ACATTTCTTTAAAATTTCCA | ACatttctttaaaattTCCA | 96.4 |
| 1879 | 1879_2 | ACATTTCTTTAAAATTTCCA | ACAtttctttaaaatttCCA | 96.6 |
| 1880 | 1880_1 | CACATTTCTTTAAAATTTCCA | CACatttctttaaaatttcCA | 95.5 |
| 1879 | 1879_3 | ACATTTCTTTAAAATTTCCA | AcatttctttaaaattTCCA | 98.1 |
| 1879 | 1879_4 | ACATTTCTTTAAAATTTCCA | ACAtttctttaaaatttcCA | 98 |
| 1881 | 1881_1 | CCACATTTCTTTAAAATTTCC | CcacatttctttaaaatTTCC | 90 |
| 1882 | 1882_1 | CACATTTCTTTAAAATTTCC | CAcatttctttaaaattTCC | 94.8 |
| 1882 | 1882_2 | CACATTTCTTTAAAATTTCC | CAcatttctttaaaatTTCC | 89.1 |
| 1882 | 1882_3 | CACATTTCTTTAAAATTTCC | CACatttctttaaaatttCC | 94.4 |
| 1883 | 1883_1 | ACATTTCTTTAAAATTTCC | ACAtttctttaaaattTCC | 91.9 |
| 1882 | 1882_4 | CACATTTCTTTAAAATTTCC | CACatttctttaaaatttCC | 92.4 |
| 1884 | 1884_1 | CCACATTTCTTTAAAATTTC | CCAcatttctttaaaattTC | 98.3 |
| 1885 | 1885_1 | ACCACATTTCTTTAAAATTTC | ACCAcatttctttaaaattTC | 97.5 |
| 1884 | 1884_2 | CCACATTTCTTTAAAATTTC | CCAcatttctttaaaattTC | 102 |
| 1884 | 1884_3 | CCACATTTCTTTAAAATTTC | CCacatttctttaaaaTTTC | 94.9 |
| 1884 | 1884_4 | CCACATTTCTTTAAAATTTC | CCAcatttctttaaaatTTC | 87.2 |
| 1886 | 1886_1 | ACCACATTTCTTTAAAATTT | ACCAcatttctttaaaatTT | 94.8 |
| 1887 | 1887_1 | ACAAAACCACATTTCTTTAA | ACAaaaccacatttctttTAA | 97.4 |
| 1888 | 1888_1 | CTGTTTTCAAATCATTTC | CTGTtttcaaatcatttTC | 15.8 |
| 1889 | 1889_1 | GAACCATTACTATTATCAA | GAaccattactattaTCAA | 27.3 |
| 1890 | 1890_1 | AGAACCATTACTATTATCA | AGAaccattactattaTCA | 19.8 |
| 1891 | 1891_1 | AGAACCATTACTATTATC | AGaaccattactatTATC | 17.9 |
| 1892 | 1892_1 | CTAGAACCATTACTATTA | CTAGaaccattactatTA | 35.3 |
| 1893 | 1893_1 | TAGAACCATTACTATTA | TAGAaccattactatTA | 13.2 |
| 1894 | 1894_1 | CTAGAACCATTACTATT | CTAGaaccattactaTT | 32.1 |
| 1895 | 1895_1 | AGATTACCATCTTTCAAAA | AGATtaccatctttcaaAA | 59.5 |
| 1895 | 1895_2 | AGATTACCATCTTTCAAAA | AGAttaccatctttcaAAA | 54.1 |
| 1896 | 1896_1 | AGATTACCATCTTTCAAA | AGATtaccatctttcaAA | 50.6 |
| 1896 | 1896_2 | AGATTACCATCTTTCAAA | AGattaccatctttCAAA | 42.3 |
| 1897 | 1897_1 | AGATTACCATCTTTCAA | AGAttaccatctttCAA | 32.4 |

TABLE 5-continued

| SEQID | CMPID | Oligonucleotide Base Sequence | Oligonucleotide compound | % of ATXN3 mRNA remaining |
|---|---|---|---|---|
| 1898 | 1898_1 | AAGATTACCATCTTTCA | AAGAttaccatctttCA | 47.9 |
| 1899 | 1899_1 | CATGCTCACACATTTTAA | CATgctcacacatttTAA | 60.5 |
| 1899 | 1899_2 | CATGCTCACACATTTTAA | CAtgctcacacattTTAA | 70.3 |
| 1899 | 1899_3 | CATGCTCACACATTTTAA | CAtgctcacacatttTAA | 69.8 |
| 1899 | 1899_4 | CATGCTCACACATTTTAA | CATGctcacacattttAA | 55.9 |
| 1900 | 1900_1 | CTTAAGCTATCTAAACA | CTTAagctatctaaaCA | 82.6 |
| 1901 | 1901_1 | TGAACAATTCAACATTCA | TGAacaattcaacatTCA | 67.7 |
| 1902 | 1902_1 | GATCAAAAAACTTTCCCT | GAtcaaaaaactttCCCT | 76.1 |
| 1903 | 1903_1 | AGATCAAAAAACTTTCCCT | AGatcaaaaaactttCCCT | 70.4 |
| 1904 | 1904_1 | AGATCAAAAAACTTTCCC | AGAtcaaaaaactttCCC | 73.6 |
| 1905 | 1905_1 | TCCTAGATCAAAAAACT | TCCTagatcaaaaaaCT | 69.9 |
| 1906 | 1906_1 | ATTTTTTCTTCTCTTTTCA | ATTTtttcttctcttttCA | 8.98 |
| 1907 | 1907_1 | TATTTTTTCTTCTCTTTTCA | TATtttttcttctcttttCA | 63.8 |
| 1908 | 1908_1 | ATATTTTTTCTTCTCTTTTC | ATatttttcttctctTTTC | 16.1 |
| 1909 | 1909_1 | TCTGCTTTAAAAACTCTC | TCtgctttaaaaacTCTC | 34.3 |
| 1910 | 1910_1 | CTCTGCTTTAAAAACTC | CTCtgctttaaaaaCTC | 51.6 |
| 1911 | 1911_1 | ACTACACAAACACATTCAA | ACtacacaaacacatTCAA | 37.6 |
| 1912 | 1912_1 | CAAACTACACAAACACATTCA | CAaactacacaaacacaTTCA | 41.2 |
| 1913 | 1913_1 | ACAAACTACACAAACACATTC | ACAaactacacaaacacaTTC | 63.1 |
| 1914 | 1914_1 | CAACAAACTACACAAACACAT | CAAcaaactacacaaacaCAT | 86.1 |
| 1915 | 1915_1 | CACAACAAACTACACAAACAC | CACaacaaactacacaaaCAC | 62.1 |
| 1916 | 1916_1 | TCACAACAAACTACACAAACA | TCACaacaaactacacaaaCA | 48.6 |
| 1917 | 1917_1 | TTCACAACAAACTACACAAAC | TTCAcaacaaactacacaaAC | 58.8 |
| 1918 | 1918_1 | ATTTCACAACAAACTACACAA | ATTtcacaacaaactacaCAA | 76.8 |
| 1919 | 1919_1 | CAATTTCACAACAAACTACAC | CAAtttcacaacaaactaCAC | 70.7 |
| 1920 | 1920_1 | TGTAACAATTTCACAACAA | TGTaacaatttcacaaCAA | 59.5 |
| 1921 | 1921_1 | TGTAACAATTTCACAACA | TGTAacaatttcacaaCA | 28.7 |
| 1922 | 1922_1 | TTAAGCCAACCCCACCA | TtaagccaaccccacCA | 83.1 |
| 1923 | 1923_1 | TTTAAGCCAACCCCACC | TttaagccaaccccACC | 69.2 |
| 1924 | 1924_1 | ATTTAAGCCAACCCCAC | AtttaagccaaccCCAC | 60.6 |
| 1925 | 1925_1 | CCAGTAATACAAATTATA | CCAGtaatacaaattaTA | 69.5 |
| 1926 | 1926_1 | CCCAGTAATACAAATTA | CCCAgtaatacaaatTA | 55.9 |
| 1927 | 1927_1 | TCCCAGTAATACAAATT | TCCCagtaatacaaaTT | 64.9 |
| 1928 | 1928_1 | ATCCCAGTAATACAAAT | ATCCcagtaataacaaAT | 65.9 |
| 1929 | 1929_1 | CTACTAGCATCACCACT | CtactagcatcacCACT | 19.8 |
| 1930 | 1930_1 | TTCTACTAGCATCACC | TtctactagcatCACC | 21.8 |
| 1931 | 1931_1 | CTTCTACTAGCATCAC | CTtctactagcaTCAC | 33.2 |
| 1932 | 1932_1 | TAAATTACTCATTAAATCCAT | TAaattactcattaaatCCAT | 77.8 |

TABLE 5-continued

| SEQID | CMPID | Oligonucleotide Base Sequence | Oligonucleotide compound | % of ATXN3 mRNA remaining |
|---|---|---|---|---|
| 1933 | 1933_1 | ATAAATTACTCATTAAATCCA | ATaaattactcattaaaTCCA | 52.4 |
| 1934 | 1934_1 | TAAATTACTCATTAAATCCA | TAaattactcattaaaTCCA | 51.6 |
| 1935 | 1935_1 | CATAAATTACTCATTAAATCC | CATaaattactcattaaaTCC | 58.5 |
| 1935 | 1935_2 | CATAAATTACTCATTAAATCC | CATaaattacTcattaaaTCC | 22.3 |
| 1936 | 1936_1 | GATTTATTTTCTACTTA | GAtttattttctaCTTA | 66 |
| 1937 | 1937_1 | ATACAACAAACAATTCACTTT | ATacaacaaacaattcaCTTT | 53.2 |
| 1937 | 1937_2 | ATACAACAAACAATTCACTTT | ATACaacaaacaattcactTT | 48.1 |
| 1938 | 1938_1 | CGATACAACAAACAATTCA | CGATacaacaaacaattCA | 23 |
| 1939 | 1939_1 | GAACATCCACACTAACAACA | GAACatccacactaacaaCA | 43.6 |
| 1940 | 1940_1 | ACATCCACACTAACAACA | ACAtccacactaacaACA | 65 |
| 1939 | 1939_2 | GAACATCCACACTAACAACA | GAAcatccacactaacaACA | 52 |
| 1939 | 1939_3 | GAACATCCACACTAACAACA | GAacatccacactaacAACA | 58.1 |
| 1941 | 1941_1 | GAACATCCACACTAACAAC | GAACatccacactaacaAC | 51.3 |
| 1941 | 1941_2 | GAACATCCACACTAACAAC | GAacatccacactaaCAAC | 63.3 |
| 1942 | 1942_1 | TGAACATCCACACTAACAA | TGAacatccacactaaCAA | 57.8 |
| 1943 | 1943_1 | TTGAACATCCACACTAACA | TTGAacatccacactaaCA | 60.3 |
| 1944 | 1944_1 | TGAACATCCACACTAACA | TGAAcatccacactaaCA | 42.6 |
| 1945 | 1945_1 | CATTGAACATCCACACTA | CATtgaacatccacaCTA | 59.4 |
| 1946 | 1946_1 | ATTGAACATCCACACTA | ATTgaacatccacaCTA | 50 |
| 1947 | 1947_1 | CATTGAACATCCACACT | CAttgaacatccaCACT | 43 |
| 1948 | 1948_1 | ACTCATTGAACATCCAC | ACtcattgaacatCCAC | 46.8 |
| 1949 | 1949_1 | TATCTTTATTTAATAATCTT | TATCtttatttaataatcTT | 93.4 |
| 1949 | 1949_2 | TATCTTTATTTAATAATCTT | TAtctttatttaataaTCTT | 96.9 |
| 1950 | 1950_1 | TCTCAAGCTTCACTCTA | TCtcaagcttcactcTA | 78.6 |
| 1951 | 1951_1 | GACAATATATTCCTCAATC | GACAatatattcctcaaTC | 73 |
| 1952 | 1952_1 | GACAATATATTCCTCAAT | GACAatatattcctcaAT | 82 |
| 1952 | 1952_2 | GACAATATATTCCTCAAT | GAcaatatattcctCAAT | 76.8 |
| 1953 | 1953_1 | TCCTGTAACAATTATAC | TCCtgtaacaattaTAC | 95.4 |
| 1954 | 1954_1 | ACCCAGAATAAAAACCAC | ACccagaataaaaaCCAC | 95.5 |
| 1955 | 1955_1 | TTCCACTTTCTTACTCCC | TtccactttcttactcCC | 96.6 |
| 1956 | 1956_1 | TTCCACTTTCTTACTCC | TtccactttcttacTCC | 86.3 |
| 1957 | 1957_1 | TTTCCACTTTCTTACTCC | TttccactttcttacTCC | 89.2 |
| 1958 | 1958_1 | TTTCCACTTTCTTACTC | TTTCcactttcttacTC | 89.2 |
| 1959 | 1959_1 | ATCCCTTTACCACTTTT | ATCcctttaccactTTT | 101 |
| 1960 | 1960_1 | CATCCCTTTACCACTTTT | CAtccctttaccactTTT | 98 |
| 1961 | 1961_1 | TCATCCCTTTACCACTTT | TCatccctttaccactTT | 101 |
| 1962 | 1962_1 | TCATCCCTTTACCACTT | TCAtccctttaccacTT | 96.9 |

TABLE 5-continued

| SEQID | CMPID | Oligonucleotide Base Sequence | Oligonucleotide compound | % of ATXN3 mRNA remaining |
|---|---|---|---|---|
| 1963 | 1963_1 | CTCATCCCTTTACCACTT | CtcatcccttaccacTT | 97.7 |
| 1964 | 1964_1 | GTCTACATCTAACCCC | GtctacatctaacCCC | 97 |
| 1965 | 1965_1 | AGTCTACATCTAACCCC | AGtctacatctaaccCC | 99.6 |
| 1966 | 1966_1 | CAGTCTACATCTAACCCC | CagtctacatctaaccCC | 97.4 |
| 1967 | 1967_1 | CAGTCTACATCTAACCC | CagtctacatctaaCCC | 99.5 |
| 1968 | 1968_1 | TCAGTCTACATCTAACCC | TCagtctacatctaacCC | 98.9 |
| 1969 | 1969_1 | AGTCTACATCTAACCC | AGTctacatctaacCC | 98.2 |
| 1970 | 1970_1 | TCAGTCTACATCTAACC | TCagtctacatctAACC | 98.3 |
| 1971 | 1971_1 | TTCAGTCTACATCTAACC | TTCagtctacatctaaCC | 98 |
| 1972 | 1972_1 | TTCAGTCTACATCTAAC | TTCAgtctacatctaAC | 98.7 |
| 1973 | 1973_1 | TTTCAGTCTACATCTAA | TTtcagtctacatCTAA | 90.1 |
| 1974 | 1974_1 | AGTTTTAACCACACCTCCT | AgttttaaccacacctcCT | 102 |
| 1975 | 1975_1 | GTTTTAACCACACCTCC | GTTttaaccacacctCC | 93.7 |
| 1976 | 1976_1 | AGTTTTAACCACACCTCC | AgttttaaccacaccTCC | 95 |
| 1977 | 1977_1 | AGTTTTAACCACACCTC | AGttttaaccacacCTC | 88.7 |
| 1978 | 1978_1 | GAGTTTTAACCACACC | GAGttttaaccacACC | 94.7 |
| 1979 | 1979_1 | CAGATCTTCTCTTTATTT | CAGatcttctctttaTTT | 96.3 |
| 1980 | 1980_1 | TGTTTTCAACAAAACATCA | TGTtttcaacaaaacaTCA | 89.9 |
| 1981 | 1981_1 | TGTTTTCAACAAAACATC | TGttttcaacaaaaCATC | 97.5 |
| 1982 | 1982_1 | CTGTTTTCAACAAAACAT | CTGttttcaacaaaaCAT | 102 |
| 1983 | 1983_1 | TCTGTTTTCAACAAAACA | TCTGttttcaacaaaaCA | 98 |
| 1984 | 1984_1 | ATCTTTCTAAAACTTACC | ATCTttctaaaacttaCC | 96.3 |
| 1985 | 1985_1 | CAGAATCTTTCTAAAACT | CAGAatctttctaaaaCT | 91.7 |
| 1986 | 1986_1 | CTACAGAATCTTTCTAA | CTacagaatctttCTAA | 97.6 |
| 1986 | 1986_2 | CTACAGAATCTTTCTAA | CTAcagaatctttcTAA | 95.6 |
| 1987 | 1987_1 | ATTTCCCTTTATTTCCCTT | AtttcccttatttccCTT | 92 |
| 1988 | 1988_1 | GTATTTCCCTTTATTTCC | GtatttcccttattTCC | 99.5 |

In the oligonucleotide compound column, capital letters represent beta-D-oxy LNA nucleosides, LNA cytosines are 5-methyl cytosine, lower case letters are DNA nucleosides, and all internucleoside linkages are phosphorothioate. $^m$c represent 5-methyl cytosine DNA nucleosides (used in compounds 1490_1 and 1491_1).

Example 4

The screening assay described in Example 2 was performed using a series of further oligonucleotide targeting human ATXN3 pre-mRNA using the qpCR: (ATXN3_exon_8-9(1) PrimeTime® XL qPCR Assay (IDT).

qPCR probe and primers set 2:

Probe:
(SEQ ID NO 1134)
5'-/56-FAM/CTCCGCAGG/ZEN/GCT ATTCAGCT AAGT /31ABkFQ/-3'

Primer 1:
(SEQ ID NO 1135)
5'-AGT AAGATTTGT ACCTGATGTCTGT-3'

Primer 2:
(SEQ ID NO 1136)
5'-CATGGAAGATGAGGAAGCAGAT-3'

TABLE 6

| SEQIDCMPID | Oligonucleotide Sequence | BaseOligonucleotide compound | % of ATXN3 mRNA remaining |
|---|---|---|---|
| 1110 1110_2 | ACATCATTTATCACTACCACA | CatcatttatcactacCAC | 44 |
| 1102 1102_2 | TATCTCAAACTATCCCCA | TatctcaaactatccCCA | 74 |
| 1104 1104_2 | TCCCCTAAATAATTTAATCATCC | cctaaataatttaaTCA | 78 |
| 1116 1116_2 | TCTTCATTATACCATCAAATTCTT | cattataccatcaaAT | 12 |
| 1121 1121_2 | CTCTCAACTTCTACTACTAAC | tctcaacttctactaCTAA | 68 |
| 1114 1114_2 | TGATTCTTATACTTACTA | TGATtcttatacttacTA | 64 |
| 1120 1120_2 | CATCACAAAATAACCTATCACAT | CacaaaataacctatCA | 38 |
| 1100 1100_2 | CCCCATTCAAATATTTATT | CCCcattcaaatatttATT | 79 |
| 1112 1112_2 | TCAGATCCTAAAATCACT | TCAGatcctaaaatcaCT | 65 |
| 1123 1123_2 | CCAAAATTACTTCTTTTATCCC | aaaattacttcctttTATC | 37 |
| 1117 1117_2 | GTTTCATATTTTTAATCC | GTttcatattttttaATCC | 10 |
| 1099 1099_2 | CCAAAAGAAACCAAACCC | CCaaaagaaaccaaACCC | 88 |
| 1109 1109_2 | TGAAACCATTACTACAACC | TGAaaccattactacaACC | 22 |
| 1113 1113_2 | CTATACCTAAAACAATCTA | CTatacctaaaacaaTCTA | 86 |
| 1119 1119_2 | CAAATATTCACAAATCCTA | CaaatattcacaaatCCTA | 78 |
| 1125 1125_2 | ACAATATATTCCTCAATCA | ACaatatattcctcaATCA | 74 |
| 1127 1127_2 | CATCCCTTTACCACTTT | CatcccttaccaCTTT | 97 |
| 1118 1118_2 | TAATATCCTCATTACCCATTT | aatatcctcattaccCATT | 97 |
| 1103 1103_2 | TCTATTCCTTAACCCAAC | TCtattccttaaccCAAC | 81 |
| 1122 1122_2 | AATCTTATTTACATCTTCC | AATCttatttacatcttCC | 11 |
| 1126 1126_2 | CCTGTAACAATTATACA | CCTGtaacaattataCA | 93 |
| 1122 1122_3 | AATCTTATTTACATCTTCC | AatcttatttacaTCtTCC | 54 |
| 1122 1122_4 | AATCTTATTTACATCTTCC | AAtcTtatttacAtCttCC | 17 |
| 1122 1122_5 | AATCTTATTTACATCTTCC | AAtcttatttacAtCttCC | 21 |
| 1122 1122_6 | AATCTTATTTACATCTTCC | AatctTatttacaTCttCC | 12 |
| 1122 1122_7 | AATCTTATTTACATCTTCC | AatcttatttacAtCttCC | 28 |
| 1122 1122_8 | AATCTTATTTACATCTTCC | AatcttatttacAtcTTCC | 28 |
| 1122 1122_9 | AATCTTATTTACATCTTCC | AAtcTtatttacAtctTCC | 11 |
| 1122 1122_10 | AATCTTATTTACATCTTCC | AatctTatttacAtctTCC | 9 |
| 1122 1122_11 | AATCTTATTTACATCTTCC | AatcTtatttacatcTTCC | 10 |
| 1122 1122_12 | AATCTTATTTACATCTTCC | AATcTtatttacAtCtCC | 10 |
| 1122 1122_13 | AATCTTATTTACATCTTCC | AatCTtatttacAtcttCC | 10 |
| 1122 1122_14 | AATCTTATTTACATCTTCC | AatCttatttacatctTCC | 7 |
| 1122 1122_15 | AATCTTATTTACATCTTCC | AatcttatttacaTCttCC | 32 |
| 1122 1122_16 | AATCTTATTTACATCTTCC | AatCttatttacatcTTCC | 4 |
| 1122 1122_17 | AATCTTATTTACATCTTCC | AatCttatttacatcTtCC | 5 |
| 1122 1122_18 | AATCTTATTTACATCTTCC | AaTcTtatttacaTcTtCC | 9 |
| 1122 1122_19 | AATCTTATTTACATCTTCC | AatcTTatttacatcTtCC | 5 |

TABLE 6-continued

| SEQIDCMPID | Oligonucleotide Sequence | BaseOligonucleotide compound | % of ATXN3 mRNA remaining |
|---|---|---|---|
| 1122 1122_20 | AATCTTATTTACATCTTCC | AatcTtatttacatCttCC | 13 |
| 1122 1122_21 | AATCTTATTTACATCTTCC | AAtcttatttacatCttCC | 23 |
| 1122 1122_22 | AATCTTATTTACATCTTCC | AatctTatttacatCttCC | 8 |
| 1122 1122_23 | AATCTTATTTACATCTTCC | AatcTTatttacatCttCC | 4 |
| 1122 1122_24 | AATCTTATTTACATCTTCC | AatctTatttacatcTTCC | 8 |
| 1122 1122_25 | AATCTTATTTACATCTTCC | AATcTTatttacatcTtCC | 5 |
| 1122 1122_26 | AATCTTATTTACATCTTCC | AAtctTatttacatcTtCC | 12 |
| 1122 1122_27 | AATCTTATTTACATCTTCC | AaTCTtatttacatcTtCC | 3 |
| 1122 1122_28 | AATCTTATTTACATCTTCC | AaTcTTatttacatcTtCC | 3 |
| 1122 1122_29 | AATCTTATTTACATCTTCC | AatCTTatttacatcTtCC | 3 |
| 1122 1122_30 | AATCTTATTTACATCTTCC | AAtcTTatttacatctTCC | 5 |
| 1122 1122_31 | AATCTTATTTACATCTTCC | AAtcTtatttacatctTCC | 12 |
| 1122 1122_32 | AATCTTATTTACATCTTCC | AAtcttatttacatctTCC | 33 |
| 1122 1122_33 | AATCTTATTTACATCTTCC | AatCtTatttacatctTCC | 3 |
| 1122 1122_34 | AATCTTATTTACATCTTCC | AatcTTatttacatctTCC | 6 |
| 1122 1122_35 | AATCTTATTTACATCTTCC | AatcTtatttacatctTCC | 16 |
| 1122 1122_36 | AATCTTATTTACATCTTCC | AATCtTatttacatcttCC | 8 |
| 1122 1122_37 | AATCTTATTTACATCTTCC | AAtcTTatttacatcttCC | 5 |
| 1122 1122_38 | AATCTTATTTACATCTTCC | AAtCttatttacatcttCC | 16 |
| 1122 1122_39 | AATCTTATTTACATCTTCC | AaTCTtatttacatcttCC | 7 |
| 1122 1122_40 | AATCTTATTTACATCTTCC | AaTCtTatttacatcttCC | 5 |
| 1122 1122_41 | AATCTTATTTACATCTTCC | AatCTTatttacatcttCC | 5 |
| 1122 1122_42 | AATCTTATTTACATCTTCC | AatCTtatttacatcttCC | 13 |
| 1122 1122_43 | AATCTTATTTACATCTTCC | AatcTTatttacatcttCC | 17 |
| 1109 1109_3 | TGAAACCATTACTACAACC | TgaaaccattacTAcaaCC | 58 |
| 1109 1109_4 | TGAAACCATTACTACAACC | TgaaaccattacTAcAaCC | 20 |
| 1109 1109_5 | TGAAACCATTACTACAACC | TgaAAccattacTacAaCC | 23 |
| 1109 1109_6 | TGAAACCATTACTACAACC | TgAaAccattactAcaaCC | 50 |
| 1109 1109_7 | TGAAACCATTACTACAACC | TgAaaCcattactAcaaCC | 46 |
| 1109 1109_8 | TGAAACCATTACTACAACC | TgaAAccattacTacaaCC | 48 |
| 1109 1109_9 | TGAAACCATTACTACAACC | TgaaaccattactaCAaCC | 25 |
| 1109 1109_10 | TGAAACCATTACTACAACC | TgaaAccattacTaCaACC | 24 |
| 1109 1109_11 | TGAAACCATTACTACAACC | TGaaAccattactaCaaCC | 36 |
| 1109 1109_12 | TGAAACCATTACTACAACC | TgAAAccattactaCaaCC | 20 |
| 1109 1109_13 | TGAAACCATTACTACAACC | TgAAaCcattactaCaaCC | 26 |
| 1109 1109_14 | TGAAACCATTACTACAACC | TgAaaccattactaCaaCC | 27 |
| 1109 1109_15 | TGAAACCATTACTACAACC | TGaAaccattacTacAaCC | 14 |

TABLE 6-continued

| SEQID | CMPID | Oligonucleotide Base Sequence | Oligonucleotide compound | % of ATXN3 mRNA remaining |
|---|---|---|---|---|
| 1109 | 1109_16 | TGAAACCATTACTACAACC | TgAaaCcattactacAACC | 12 |
| 1109 | 1109_17 | TGAAACCATTACTACAACC | TgaaaCcattacTacAaCC | 36 |
| 1109 | 1109_18 | TGAAACCATTACTACAACC | TgaaaCcattacTacaaCC | 62 |
| 1109 | 1109_19 | TGAAACCATTACTACAACC | TGaaAccattactacaaCC | 47 |
| 1109 | 1109_20 | TGAAACCATTACTACAACC | TgaAaccattactaCAaCC | 19 |
| 1109 | 1109_21 | TGAAACCATTACTACAACC | TgaAaccattactACaACC | 16 |
| 1109 | 1109_22 | TGAAACCATTACTACAACC | TgAAaccattactACaACC | 9 |
| 1109 | 1109_23 | TGAAACCATTACTACAACC | TgAaAccattactAcaACC | 29 |
| 1109 | 1109_24 | TGAAACCATTACTACAACC | TgaaaCcattactAcaACC | 41 |
| 1109 | 1109_25 | TGAAACCATTACTACAACC | TgaAACcattactAcaaCC | 34 |
| 1109 | 1109_26 | TGAAACCATTACTACAACC | TgaAaCcattactaCaaCC | 28 |
| 1109 | 1109_27 | TGAAACCATTACTACAACC | TGaAaCcattactacAACC | 10 |
| 1109 | 1109_28 | TGAAACCATTACTACAACC | TgAAaCcattactAcAACC | 52 |
| 1109 | 1109_29 | TGAAACCATTACTACAACC | TGaAAccattactacaACC | 16 |
| 1109 | 1109_30 | TGAAACCATTACTACAACC | TGAaaccattactacaaCC | 36 |
| 1109 | 1109_31 | TGAAACCATTACTACAACC | TgaaaCcattactaCaACC | 21 |
| 1109 | 1109_32 | TGAAACCATTACTACAACC | TgAAAccattactacAACC | 9 |
| 1109 | 1109_33 | TGAAACCATTACTACAACC | TgAaaCcattactacAaCC | 14 |
| 1109 | 1109_34 | TGAAACCATTACTACAACC | TGaaaccattactacaACC | 43 |
| 1109 | 1109_35 | TGAAACCATTACTACAACC | TgAAaCcattactacaACC | 15 |
| 1109 | 1109_36 | TGAAACCATTACTACAACC | TgaAACcattactacaaCC | 15 |
| 1109 | 1109_37 | TGAAACCATTACTACAACC | TGaAaCcattactacaaCC | 16 |
| 1109 | 1109_38 | TGAAACCATTACTACAACC | TGaaaCcattactacaaCC | 38 |
| 1109 | 1109_39 | TGAAACCATTACTACAACC | TgAAAccattactacaaCC | 14 |
| 1109 | 1109_40 | TGAAACCATTACTACAACC | TgAAaCcattactacaaCC | 16 |
| 1109 | 1109_41 | TGAAACCATTACTACAACC | TgaAaCcattactacaaCC | 28 |
| 1109 | 1109_42 | TGAAACCATTACTACAACC | TgaaACcattactacaaCC | 28 |
| 1122 | 1122_44 | AATCTTATTTACATCTTCC | AatcttatttacaTCTtCC | 65 |
| 1122 | 1122_45 | AATCTTATTTACATCTTCC | AatcTtatttacAtCttCC | 38 |
| 1122 | 1122_46 | AATCTTATTTACATCTTCC | AatcTtatttacaTcTTCC | 34 |
| 1122 | 1122_47 | AATCTTATTTACATCTTCC | AAtCttatttacAtcTtCC | 10 |
| 1122 | 1122_48 | AATCTTATTTACATCTTCC | AAtcTtatttacATcTtCC | 35 |
| 1122 | 1122_49 | AATCTTATTTACATCTTCC | AatCttatttacAtcTtCC | 10 |
| 1122 | 1122_50 | AATCTTATTTACATCTTCC | AAtCttatttacAtcttCC | 11 |
| 1122 | 1122_51 | AATCTTATTTACATCTTCC | AAtctTatttacatCTtCC | 9 |
| 1122 | 1122_52 | AATCTTATTTACATCTTCC | AatcTTatttacAtcTtCC | 12 |
| 1122 | 1122_53 | AATCTTATTTACATCTTCC | AatctTatttacatCTtCC | 8 |
| 1122 | 1122_54 | AATCTTATTTACATCTTCC | AaTcTtatttacatcTTCC | 4 |

TABLE 6-continued

| SEQIDC | MPID | Oligonucleotide Base Sequence | Oligonucleotide compound | % of ATXN3 mRNA remaining |
|---|---|---|---|---|
| 1122 | 1122_55 | AATCTTATTTACATCTTCC | AAtcttatttacAtcTtCC | 27 |
| 1122 | 1122_56 | AATCTTATTTACATCTTCC | AAtCtTatttacAtcttCC | 5 |
| 1122 | 1122_57 | AATCTTATTTACATCTTCC | AAtcTTatttacatcttCC | 14 |
| 1122 | 1122_58 | AATCTTATTTACATCTTCC | AaTCttatttacatcttCC | 13 |
| 1122 | 1122_59 | AATCTTATTTACATCTTCC | AATcttatttacatCttCC | 6 |
| 1122 | 1122_60 | AATCTTATTTACATCTTCC | AAtcTtatttacatCttCC | 10 |
| 1122 | 1122_61 | AATCTTATTTACATCTTCC | AAtcTTatttacatcTtCC | 6 |
| 1122 | 1122_62 | AATCTTATTTACATCTTCC | AatCtTatttacatcTtCC | 3 |
| 1122 | 1122_63 | AATCTTATTTACATCTTCC | AATCttatttacaTcttCC | 5 |
| 1122 | 1122_64 | AATCTTATTTACATCTTCC | AatCttatttacatcTtCC | 7 |
| 1122 | 1122_65 | AATCTTATTTACATCTTCC | AatCttatttacatcttCC | 32 |
| 1122 | 1122_66 | AATCTTATTTACATCTTCC | AatcttatttacatcTTCC | 19 |
| 1122 | 1122_67 | AATCTTATTTACATCTTCC | AATCttatttacatcTtCC | 3 |
| 1122 | 1122_68 | AATCTTATTTACATCTTCC | AATcTtatttacatcTtCC | 4 |
| 1122 | 1122_69 | AATCTTATTTACATCTTCC | AAtCTtatttacatcTtCC | 3 |
| 1122 | 1122_70 | AATCTTATTTACATCTTCC | AAtCtTatttacatcTtCC | 3 |
| 1122 | 1122_71 | AATCTTATTTACATCTTCC | AAtcTtatttacatcTtCC | 13 |
| 1122 | 1122_72 | AATCTTATTTACATCTTCC | AaTCttatttacatcTtCC | 5 |
| 1122 | 1122_73 | AATCTTATTTACATCTTCC | AatCTtatttacatcTtCC | 5 |
| 1122 | 1122_74 | AATCTTATTTACATCTTCC | AatctTatttacatcTtCC | 10 |
| 1122 | 1122_75 | AATCTTATTTACATCTTCC | AAtCTtatttacatctTCC | 3 |
| 1122 | 1122_76 | AATCTTATTTACATCTTCC | AAtCttatttacatctTCC | 5 |
| 1122 | 1122_77 | AATCTTATTTACATCTTCC | AaTCttatttacatctTCC | 5 |
| 1122 | 1122_78 | AATCTTATTTACATCTTCC | AatCTtatttacatctTCC | 4 |
| 1122 | 1122_79 | AATCTTATTTACATCTTCC | AAtCTtatttacatcttCC | 7 |
| 1122 | 1122_80 | AATCTTATTTACATCTTCC | AAtCtTatttacatcttCC | 5 |
| 1122 | 1122_81 | AATCTTATTTACATCTTCC | AatCtTatttacatcttCC | 8 |
| 1109 | 1109_43 | TGAAACCATTACTACAACC | TgAAaccattacTAcAaCC | 18 |
| 1109 | 1109_44 | TGAAACCATTACTACAACC | TgAaAccattacTacAaCC | 27 |
| 1109 | 1109_45 | TGAAACCATTACTACAACC | TgaAaCcattacTacAaCC | 65 |
| 1109 | 1109_46 | TGAAACCATTACTACAACC | TgAaaccattacTacaACC | 25 |
| 1109 | 1109_47 | TGAAACCATTACTACAACC | TgaAaccattacTacaACC | 35 |
| 1109 | 1109_48 | TGAAACCATTACTACAACC | TgaaAccattacTacaACC | 48 |
| 1109 | 1109_49 | TGAAACCATTACTACAACC | TgaAaCcattacTacaaCC | 44 |
| 1109 | 1109_50 | TGAAACCATTACTACAACC | TgaAaccattacTaCaaCC | 34 |
| 1109 | 1109_51 | TGAAACCATTACTACAACC | TGaaaccattacTacaACC | 29 |
| 1109 | 1109_52 | TGAAACCATTACTACAACC | TgAAaccattacTacaACC | 23 |

TABLE 6-continued

| SEQID | CMPID | Oligonucleotide Sequence | BaseOligonucleotide compound | % of ATXN3 mRNA remaining |
|---|---|---|---|---|
| 1109 | 1109_53 | TGAAACCATTACTACAACC | TgaaaCcattacTaCaaCC | 39 |
| 1109 | 1109_54 | TGAAACCATTACTACAACC | TGaaaccattactaCaaCC | 33 |
| 1109 | 1109_55 | TGAAACCATTACTACAACC | TgAaAccattactaCaaCC | 29 |
| 1109 | 1109_56 | TGAAACCATTACTACAACC | TGaaAccattactacAACC | 16 |
| 1109 | 1109_57 | TGAAACCATTACTACAACC | TGaaAccattactacAaCC | 18 |
| 1109 | 1109_58 | TGAAACCATTACTACAACC | TgAaACcattactacaaCC | 12 |
| 1109 | 1109_59 | TGAAACCATTACTACAACC | TgAaaccattactaCAaCC | 13 |
| 1109 | 1109_60 | TGAAACCATTACTACAACC | TgaaAccattactACaaCC | 36 |
| 1109 | 1109_61 | TGAAACCATTACTACAACC | TGaaaccattactAcaACC | 34 |
| 1109 | 1109_62 | TGAAACCATTACTACAACC | TgAaaCcattactACaaCC | 43 |
| 1109 | 1109_63 | TGAAACCATTACTACAACC | TGaAAccattactaCaaCC | 19 |
| 1109 | 1109_64 | TGAAACCATTACTACAACC | TGaaaCcattactACaaCC | 29 |
| 1109 | 1109_65 | TGAAACCATTACTACAACC | TGaAaccattactAcaaCC | 40 |
| 1109 | 1109_66 | TGAAACCATTACTACAACC | TgaAAccattactAcAACC | 14 |
| 1109 | 1109_67 | TGAAACCATTACTACAACC | TGaAaccattactAcAaCC | 14 |
| 1109 | 1109_68 | TGAAACCATTACTACAACC | TGaaaCcattactAcAaCC | 27 |
| 1109 | 1109_69 | TGAAACCATTACTACAACC | TgAaaCcattactAcAACC | 31 |
| 1109 | 1109_70 | TGAAACCATTACTACAACC | TgAaAccattactAcAaCC | 24 |
| 1109 | 1109_71 | TGAAACCATTACTACAACC | TgaaACcattactacAACC | 10 |
| 1109 | 1109_72 | TGAAACCATTACTACAACC | TGAaaccattactacAaCC | 11 |
| 1109 | 1109_73 | TGAAACCATTACTACAACC | TgaAACcattactAcAaCC | 34 |
| 1109 | 1109_74 | TGAAACCATTACTACAACC | TGaAaCcattactacaACC | 15 |
| 1109 | 1109_75 | TGAAACCATTACTACAACC | TGaaACcattactacaaCC | 14 |
| 1109 | 1109_76 | TGAAACCATTACTACAACC | TGaAaccattactaCaaCC | 22 |
| 1109 | 1109_77 | TGAAACCATTACTACAACC | TgaAAccattactaCaaCC | 30 |
| 1109 | 1109_78 | TGAAACCATTACTACAACC | TgaaAccattactaCaaCC | 50 |
| 1109 | 1109_79 | TGAAACCATTACTACAACC | TgaAACcattactacAaCC | 9 |
| 1109 | 1109_80 | TGAAACCATTACTACAACC | TGaAaccattactacaaCC | 31 |
| 1109 | 1109_81 | TGAAACCATTACTACAACC | TgAaaCcattactacaaCC | 31 |

In the oligonucleotide compound column, capital letters represent beta-D-oxy LNA nucleosides, LNA cytosines are 5-methyl cytosine, lower case letters are DNA nucleosides, and all internucleoside linkages are phosphorothioate.

Example 5 Testing In Vitro Efficacy of LNA Oligonucleotides in iCell GlutaNeurons at 25 µM An oligonucleotide screen was performed in a human cell line using selected LNA oligonucleotides from the previous examples.

The iCell GlutsNeurons derived from human induced pluripotent stem cell were purchased from the vendor listed in table 3, and were maintained as recommended by the supplier in a humidified incubator at 37° C. with 5% $CO_2$. For the screening assays, cells were seeded in 96 multi well plates in media recommended by the supplier (see table 3 in the Materials and Methods section). The number of cells/well was optimized (Table 3).

Cells were grown for 7 days before addition of the oligonucleotide in concentration of 25 µM (dissolved in medium). 4 days after addition of the oligonucleotide, the cells were harvested. RNA extraction and qPCR was performed as described for "Example 1"

Primer assays for ATXN3 and house keeping gene were:
ATXN3 primer assay (Assay ID: N/A, Item Name: Hs.PT.58.39355049):

```
Forward primer:
                                     (SEQ ID NO 1128)
GTTTCTAAAGACATGGTCACAGC Reverse:
                                     (SEQ ID NO 1129)
CTATCAGGACAGAGTTCACATCC Probe:
                                     (SEQ ID NO 1030)
56-FAM/AAAGGCCAG/ZEN/CCACCAGTTCAGG/3IABkFQ/
```

TBP primer assay (Assay ID: N/A, Item name: Hs.PT.58v.39858774

```
Probe:
                                     (SEQ ID NO 1131)
5'- /5HEX/TGA TCT TTG /ZEN/CAG TGA CCC AGC ATC A/3IABkFQ/ -3'

Primer 1:
                                     (SEQ ID NO 1132)
5'- GCT GTT TAA CTT CGC TTC CG-3'

Primer 2:
                                     (SEQ ID NO 1133)
5'- CAG CAA CTT CCT CAA TTC CTT G-3'
```

The relative ATXN3 mRNA expression levels were determined as % of control (medium-treated cells) i.e. the lower the value the larger the inhibition.

The compounds tested and the target knock-down data is presented in the Table 7.

Example 6 Determination of EC50 Values of LNA Gapmers Targeting ATXN3

Values for EC50 (concentration at which half effect on target knockdown is observed) was determined for the cell lines SK-N-AS, A431 and iPSCs (iCell GlutaNeurons). The following oligoconcentrations were used:
  SK-N-AS: 50 µM—half log dilution (3.16 fold)—8 steps including blank control
  A431: 50 µM—half log dilution (3.16 fold)—8 steps including blank control
  iPCS: 10 µM—10 fold dilution—8 steps including blank control The cells were treated with oligo, lysed and analysed as indicated in previous examples.

The compounds tested and their EC50 values is shown in table 7.

Example 7 In Vitro Toxicity Evaluation

The criterion for selection of oligonucleotides assessed in the various safety assays is based on the magnitude and frequency of signals obtained. Safety assays used were: Caspase activation, hepatotoxicity, nephrotoxicity toxicity and immunotoxicity assays. The signals obtained in the individual in vitro safety assays result in a score (0—safe, 0.5 borderline toxicity, 1—mild toxicity, 2—medium toxicity and 3—severe toxicity) and are summarized into a cumulative score for each sequence (See table 7), providing an objective ranking of compounds. As reported in the references provided, the signal strength is a measure of risk for in vivo toxicity based on validation of the assays using in vivo relevant reference molecules In vitro toxicity assays were performed as described in the following references:
  Caspase activation assay: Dieckmann et al., Molecular Therapy: Nucleic Acids Vol. 10 Mar. 2018, pp 45-54.
  Hepatotoxicity toxicity assay: Sewing et al., Methods in Molecular Biology Oligonucleotide-Based Therapies MIMB, volume 2036, pp 249-259 2019, Sewing et al., PLOS ONE DOI:10.1371/journal.pone.0159431 Jul. 21, 2016.
  Nephrotoxicity toxicity assay: Moisan et al., Mol Ther Nucleic Acids. 2017 Mar. 17; 6:89-105. doi: 10.1016/j.omtn.2016.11.006. Epub 2016 Dec. 10.
  Immunotoxicity: Sewing et al., PLoS One. 2017 Nov. 6; 12(11):e0187574. doi: 10.1371/journal.pone.0187574. eCollection 2017.

As part of the screening cascade 1170 compounds were evaluated in the cell lines SK-N-AS and A431 where compound efficacy was evaluated (Tables 4-6). Of these, 50 of the most effective compounds were evaluated for caspase activation of which 18 underwent further evaluation in the descrived in the three other in vitro tox assays (cumulative score is shown in Table 7).

Conclusively, 8 compounds were identified as being highly effective and potent in vitro, and with a low or absent toxicity in the 4 in vitro assays—these compounds were therefore selected for evaluated in transgenic mice expressing human ATNX3 pre-mRNA: Compounds #1856_1, 1813_1, 1812_1, 1809_2, 1607_1, 1122_62, 1122_67 and 1122_33.

TABLE 7

Data obtained from examples 5, 6 & 7

| CMPID | Total tox score | SK-N-AS EC50 (µM) | A-431 EC50 (µM) | HiPSC EC50 (µM) | HiPCS, Maximal efficacy at 25 µM (% remaining ATXN3 transcript) |
|---|---|---|---|---|---|
| 1856_1 | 1.5 | 0.53 | 0.22 | 0.23 | 2.87 |
| 1806_2 | 2 | 0.35 | 0.19 | 0.03 | 0.91 |
| 1888_1 | — | 0.72 | 0.54 | — | |
| 1813_1 | 2 | 0.24 | 0.08 | 0.04 | 1.85 |
| 1640_1 | — | 1.50 | 0.19 | — | |
| 1812_1 | 1.5 | 0.20 | 0.09 | 0.09 | 0.59 |
| 1117_2 | — | 0.73 | 0.57 | — | |
| 1810_1 | — | 0.36 | 0.14 | — | |
| 1809_2 | 1.25 | 0.22 | 0.09 | 0.05 | 1.44 |
| 1489_1 | — | 1.16 | 0.30 | — | |
| 1867_1 | — | 0.54 | 0.50 | — | |
| 1893_1 | — | 0.95 | 0.34 | 0.41 | 4 |
| 1906_1 | — | 0.36 | 0.57 | 0.04 | 2.55 |
| 1214_1 | — | 1.05 | 0.38 | — | |
| 1213_1 | — | 1.01 | 0.38 | — | |
| 1423_1 | — | 0.75 | 0.23 | 0.03 | 3.58 |
| 1790_1 | — | 0.42 | 0.47 | — | |
| 1605_1 | — | 0.47 | 0.17 | — | |
| 1607_1 | 2.5 | 0.32 | 0.25 | 0.08 | 4.46 |
| 1805_1 | — | 0.75 | 0.23 | — | |
| 1806_1 | — | 0.45 | 0.20 | 0.04 | 1.3 |
| 1809_1 | 3 | 0.24 | 0.20 | 0.02 | 1.81 |
| 1808_1 | 2 | 0.26 | 0.22 | 0.06 | 1.4 |
| 1625_1 | 0.5 | 0.94 | 0.25 | 0.66 | 7.16 |
| 1122_54 | — | 0.62 | 0.15 | — | |
| 1122_16 | — | 0.30 | 0.15 | — | |
| 1122_17 | — | 0.33 | 0.17 | 0.11 | 1.07 |
| 1122_62 | 0.5 | 0.21 | 0.10 | 0.03 | 3.53 |
| 1122_19 | — | 0.28 | 0.24 | — | |
| 1122_23 | — | 0.54 | 0.18 | 0.05 | 0.59 |

TABLE 7-continued

Data obtained from examples 5, 6 & 7

| CMPID | Total tox score | SK-N-AS EC50 (µM) | A-431 EC50 (µM) | HiPSC EC50 (µM) | HiPCS, Maximal efficacy at 25 µM (% remaining ATXN3 transcript) |
|---|---|---|---|---|---|
| 1122_67 | 0 | 0.29 | 0.10 | 0.01 | 0.52 |
| 1122_68 | — | 0.28 | 0.13 | 0.01 | |
| 1122_69 | — | 0.27 | 0.12 | — | |
| 1122_70 | — | 0.20 | 0.10 | — | |
| 1122_27 | 1 | 0.23 | 0.12 | 0.03 | 0.55 |
| 1122_72 | 0.5 | 0.25 | 0.15 | 0.06 | 2.28 |
| 1122_28 | 1 | 0.20 | 0.12 | 0.01 | 0.37 |
| 1122_29 | — | 0.19 | 0.09 | 0.02 | 1.6 |
| 1122_73 | — | 0.29 | 0.18 | 0.04 | 1.59 |
| 1122_75 | 1 | 0.44 | 0.12 | 0.03 | 2 |
| 1122_76 | — | 0.33 | 0.19 | — | |
| 1122_77 | 1 | 0.30 | 0.20 | 0.04 | 1.97 |
| 1122_78 | — | 0.29 | 0.18 | 0.02 | 1.91 |
| 1122_33 | 1.25 | 0.18 | 0.10 | 0.02 | 1.84 |
| 1122_37 | — | 0.25 | 0.13 | 0.03 | 0.89 |
| 1122_80 | — | 0.33 | 0.17 | — | |
| 1122_41 | — | 0.24 | 0.16 | 0.01 | 0.47 |
| 1109_22 | — | 0.90 | 0.23 | 0.11 | 8.41 |
| 1109_32 | 0 | 0.75 | 0.17 | 0.09 | 3.49 |
| 1109_79 | — | 1.48 | 0.20 | — | |

Example 7: In Vivo Transgenic Mouse Study

Animal Care

In vivo activity and tolerability of the compounds were tested in 10-13 week old B6;CBA-Tg(ATXN3*)84.2 Cce/IbezJ male and female mice (JAX® Mice, The Jackson Laboratory) housed 3-5 per cage. The mice are transgenic mice which express the human ATXN3 pre-mRNA sequence, with 84 CAG repeats motif, an allele which is associated with MJD in humans). Animals were held in colony rooms maintained at constant temperature (22±2° C.) and humidity (40+80%) and illuminated for 12 hours per day (lights on at 0600 hours). All animals had ad libitum access to food and water throughout the studies. All procedures are performed in accordance with the respective Swiss regulations and approved by the Cantonal Ethical Committee for Animal Research.

Administration Route—Intra-Cisterna Magna Injections.

The compounds were administered to mice by intra cisterna magna (ICM) injections. Prior to ICM injection the animals received 0.05 mg/kg Buprenorphine dosed sc as analgesia. For the ICM injection animals were placed in isofluran. Intracerebroventricular injections were performed using a Hamilton micro syringe with a FEP catheter fitted with a 36 gauge needle. The skin was incised, muscles retracted and the atlanto-occipital membrane exposed. Intracerebroventricular injections were performed using a Hamilton micro syringe with a catheter fitted with a 36 gauge needle. The 4 microliter bolus of test compound or vehicle was injected over 30 seconds. Muscles were repositioned and skin closed with 2-3 sutures. Animals were placed in a varm environment until they recovered from the procedure.

2 independent experiments were performed with groups of different compounds as shown in Table 8.

TABLE 8

| Compound ID | Dose, µg | Time-point | Group Size |
|---|---|---|---|
| Saline only | 0 | 4 wk | 6 |
| 1856_1 | 250 | 4 wk | 8 |
| 1813_1 | 250 | 4 wk | 8 |
| 1812_1 | 250 | 4 wk | 8 |
| 1809_2 | 250 | 4 wk | 8 |
| 1607_1 | 250 | 4 wk | 8 |
| 1122_62 | 250 | 4 wk | 8 |
| 1122_67 | 250 | 4 wk | 8 |
| 1122_33 | 250 | 4 wk | 8 |

Tolerability Results:

All compounds were found to be tolerated up to the 4 weeks timepoint. Acute toxicity was measured by monitoring the animal's behavior as described in WO2016/126995 (see example 9). Sub-acute toxicity was measured by monitoring the body weight of each animal during the time course of the experiment, with >5% weight reduction indicative of sub-acute toxicity. In some groups 1 or 2 animals did show some distress after the ICM administration and were euthanized, but this was likely to be due to the procedure rather than a adverse toxicity of any of the compounds. All eight compounds were therefore considered to be well tolerated in vivo.

4 weeks post administration, the animals were sacrificed, and tissues from the cortex, midbrain, cerebellum, hippocampus pons/medulla and striatum were collected weighed and snap frozen in liquid N2 directly after sampling. Samples were stored on dry ice until storage at −80° C.

Analysis of In Vivo Samples. Description of Tissue Preparation for Content Measurement and qPCR.

Mouse tissue samples were homogenized in the MagNA Pure LC RNA Isolation Tissue Lysis Buffer (Roche, Indianapolis, Ind.) using a Qiagen TissueLyzer II. The homogenates were incubated for 30 minutes at room temperature for complete lysis. After lysis the homogenates were centrifuged for 3 minutes at 13000 rpm and the supernatant used for analysis. Half was set aside for bioanalysis and for the other half, RNA extraction was continued directly.

Oligo Content Analysis

For bioanalysis, the samples were diluted 10-50 fold for oligo content measurements with a hybridization ELISA method. A biotinylated LNA-capture probe and a digoxigenin-conjugated LNA-detection probe (both 35 nM in 5×SSCT, each complementary to one end of the LNA oligonucleotide to be detected) was mixed with the diluted homogenates or relevant standards, incubated for 30 minutes at RT and then added to a streptavidine-coated ELISA plates (Nunc cat. no. 436014).

The plates were incubated for 1 hour at RT, washed in 2×SSCT (300 mM sodium chloride, 30 mM sodium citrate and 0.05% v/v Tween-20, pH 7.0) The captured LNA duplexes were detected using an anti-DIG antibodies conjugated with alkaline phosphatase (Roche Applied Science cat. No. 11093274910) and an alkaline phosphatase substrate system (Blue Phos substrate, KPL product code 50-88-00). The amount of oligo complexes was measured as absorbance at 615 nm on a Biotek reader.

Data was normalized to the tissue weight and expressed as nM of oligo.

mRNA Analysis

RNA was purified from 350 µL of supernatant using the MagNA Pure 96 instrument using the kit Cellular RNA Large Volume Kit (Roche, Indianapolis, Ind.). RNA samples were normalized to 2 ng/μL in RNase-Free water and stored at −20° C. until further use.

For one-step qPCR (cDNA synthesis and qPCR), each sample was run in duplicates with four probe sets (IDT, Leuven, Belgium) run in duplex.

To each reaction 4 μL of previously diluted RNA, 0.5 μL of water and 5.5 μL of TaqMan MasterMix was added. Plates were centrifuged and heat-chocked at 90° C. for 40 sek followed by a short incubation on ice before analyzing the samples using qPCR (Incubation at 50° C. for 15 minutes and 90° C. for 3 minutes followed by 40 cycles at 95° C. for 5 sec and 60° C. for 45 sec). Assay probes are described below.

Data was analyzed using the relative standard curve method where each is first normalized to the housekeeping gene (RPL4) and then expressed as percent of untreated control animals.

qPCR assays for in vivo studies:

Human ATXN3, qPR assay: (ATXN3_exon_8-9(1) PrimeTime® XL qPCR Assay (IDT).

qPCR probe and primers:

```
Probe:
                                        (SEQ ID NO 1134)
5'-/56-FAM/CTCCGCAGG/ZEN/GCT ATTCAGCT AAGT /

3IABkFQ/-3'

Primer 1:
                                        (SEQ ID NO 1135)
5'-AGT AAGATTTGT ACCTGATGTCTGT-3'

Primer 2:
                                        (SEQ ID NO 1136)
5'-CATGGAAGATGAGGAAGCAGAT-3'
```

House keeping gene used:

Mouse RPL4, qPCR assay (Mm.PT.58.17609218) PrimeTime® XL qPCR Assay (IDT).

qPCR probe and primers:

```
Probe:
                                        (SEQ ID NO 1090)
5'- /5HEX/CTG AAC AGC /ZEN/CTC CTT GGT CTT CTT GTA /3IABkFQ/-3'

Primer 1:
                                        (SEQ ID NO 1091)
5'- CTT GCC AGC TCT CAT TCT CTG-3'

Primer 2:
                                        (SEQ ID NO 1092)
5'- TGG TGG TTG AAG ATA AGG TTG A-3'
```

Example 8: Testing In Vitro Efficacy of LNA Oligonucleotides and Reference Compounds in a Time Course, Dose Range Experiment in Human iPSC-Derived Neurons Compounds used: 1122_67 and 1813_1 & the following reference compounds disclosed in WO2019/217708, as referenced by the Compound ID numbers used in WO2019/217708: 1100673, 1101657, 1102130, 1103014 & 1102987. Compounds 1100673, 1101657, 1102130 are highlighted in WO2019/217708 as providing potent in vivo inhibition, compounds 1103014 and 1102987 were not evaluated in vivo in WO2019/217708, but are included as reference compounds due to the sequence similarity to compound 1122_67 (1103014) and 1813_1 (1102987).

The iCell GlutaNeurons cells were prepared and maintained as described in example 5 & Table 3. Cells were grown for 7 days before addition of the oligonucleotide in concentration of 0-10 μM (dissolved in medium).

Cells were harvested at 4 days, 6 days, 9 days, 12 days and 20 days after oligo treatment, and RNA extraction and qPCR was performed as described for "Example 1", using the ATXN3 primar assay described in example 5. The relative ATXN3 mRNA expression levels were determined as % of control (medium-treated cells) i.e. the lower the value the larger the inhibition. The results are shown in Table 9

TABLE 9

| | EC50 in hiPSC-derived neurons, nM | | | | |
|---|---|---|---|---|---|
| Compound | Day 4 | Day 6 | Day 9 | Day 12 | Day 20 |
| 1122_67 | 7.2 | 1.3 | 1.4 | 1.1 | 1.1 |
| 1813_1 | 23 | 6.3 | 10 | 8.9 | 7.7 |
| 1100673 | 110 | 27 | 30 | 34 | 44 |
| 1101657 | 515 | 204 | 69 | 90 | 73 |
| 1102130 | 315 | 164 | 390 | 101 | 133 |
| 1103014 | 662 | 64 | 435 | 98 | 369 |
| 1102987 | 944 | 305 | 135 | 391 | 200 |

Compounds 1122_67 and 1813_1 were remarkably more potent than the 5 reference compounds, with compound 1122_67 being the most potent compound at all time points and both 1122_67 and 1813_1 gave a remarkably effective and long lasting inhibition of ATXN3 mRNA.

Example 9: Comparative In Vivo Transgenic Mouse Study

A further in vivo study was performed at Charles River Laboratories Den Bosch B. V., Groningen, NL, using compound 1122_67 and 1813_1, and reference compound 1100673 (WO2019/217708). The study used male and female B6;CBA-Tg(ATXN3184.2 Cce/IbezJ mice with the compounds administered via intracisternal (ICM) administration. At two timepoints after compound administration, 1 or 4 weeks, animals were euthanized and terminal plasma samples and tissues were collected.

Animal Care

In vivo activity and tolerability of the compounds were tested in 62 B6;CBA-Tg(ATXN3*)84.2 Cce/IbezJ male and female mice (JAX® Mice, The Jackson Laboratory) at the age between 7-10 weeks. Following arrival, animals were housed in groups up to 5 in individually vented cages (IVC, 40×20×16 cm) in a temperature (22±2° C.) and humidity (55±15%) controlled environment on a 12 hour light cycle (07.00-19.00 h). Males and females were kept in separate cages. Standard diet (SDS Diets, RM1 PL) and domestic quality mains water were available ad libitum. If required, animals received soaked chow and/or Royal Canin in addition to Standard diet as part of pamper care. The experiments were conducted in strict accordance with the Guide for the Care and Use of Laboratory Animals (National Research Council 2011) and were in accordance with European Union directive 2010/63 and the Dutch law. The in vivo experiment described was performed at Charles River Laboratories Den Bosch B.V. location Groningen (Groningen, the Netherlands).

Administration Route—Intra-Cisterna Magna Injections.

The compounds were administered to mice by intra cisterna magna (ICM) injections. Mice were anesthetized using isoflurane (2.5-3% and 500 mL/min O2). Before surgery, Finadyne (1 mg/kg, s.c.) was administered for analgesia during surgery and the post-surgical recovery period. A mixture of bupivacaine and epinephrine was applied to the incision site and periost of the skull for local analgesia.

Animals were placed in a stereotaxic frame (Kopf instruments, USA) and an incision made at the back of the head towards the neck. Then, the skin was spread and the coordinates marked prior to drilling a hole in the occipital bone of the skull, where a cannula was placed. Next, the compounds were injected into the cisterna magna (ICM). A volume of 4 µL of the assigned test item was injected over 30 seconds. After injection, the needle and cannula were held in place for 30 seconds to ensure no back flow occurred. The cannula was then retracted, the hole was covered with skin and the incision was closed by sutures.

Animals were placed in a warm environment until recovered from the procedure.

Compound 1122_67 was administered at a single dose of 90, 150 or 250 µg, and compound 1813_1 was administered at a single dose of 150 µg or 250 µg. The reference compound 1100673 was administered at a single dose of 250 µg only.

From three days prior to ICM injections, up to one week after administration, animal's weight was registered daily. Animal's weight was monitored and registered at least twice a week for the rest of the experiment.

At the end of the experiment, on day 8 or 29 (1 or 4 weeks), the animals were euthanized by Euthasol® overdose. Terminal plasma was collected in Li-Hep tubes. Terminal tissues were harvested from the animals and were dissected on a chilled surface. Half of the tissue samples were stored in 2.0 mL Safe-Lock tubes, PCR clean, pre-weighted and precooled. Immediately after collection, samples were weighed and flash frozen in liquid N2 prior to storage at −80° C. The other half was fixed in 4% PFA for 72 hours and subsequently transferred to 70% ethanol awaiting shipment. Tissue dissection and collection was performed, collecting tissue from a range of tissues: Midbrain, Cortex, Striatum, Hippocampus, Cerebellum, Brainstem, and spinal cord (Cervical, Thoracic & Lumbar).

Tolerability Results:

Acute toxicity was measured by monitoring the animal's behavior as described in WO2016/126995 (see example 9). Chronic toxicity was measured by monitoring the body weight of each animal during the time course of the experiment, with >5% weight reduction indicative of chronic toxicity. In some groups 1 or 2 animals did show some distress after the ICM administration and were euthanized, but this was likely to be due to the nature of the surgical procedure rather than a adverse toxicity of any of the compounds.

There were signs of acute toxicity at the 250 µg dose of 1813_1 is 3 mice, leading to early euthanisation of this group of animals. Otherwise all compounds were found to be tolerated up to the 4 weeks timepoint.

After 4 weeks the animals were eutyhanised and brain and CNS tissue collected: Spinal cord, cortex, striatum, hippocampus, midbrain, brainstem and cerebellum as well as liver and kidney was collected in liquid nitrogen for drug concentration analysis an ATAXN3 mRNA analysis at 1 or 4 weeks following dosing.

Analysis of in vivo samples: Description of tissue preparation for content measurement and qPCR was performed as per Example 7. The EC50 was calculated, and maximum KD achieved recorded—this data is provided in Table 10.

Compound 1122_67 was the most effective compound in all brain tissues tested and gave an excellent effective knock-down in all brain tissues tested, indicating good bio-distribution to all key tissues (1813_1 was as effective as 1122_67 in spinal cord, brainstem and midbrain). Notably compound 1122_67 gave highly effective knock-down in cerebellum, a tissue which the reference compound 1100673 was notably less effective. A further key observation at the after 4 weeks of treatment is that the efficacy of 1122_67 was even further improved as compared to the 1 week timepoint in all brain tissues. Notably, the efficacy of the reference compound, 1100673 was notably lower at the 4 week stage vs. the 1 week timepoint, particularly in key cerebellum and cortex tissues. The long duration of action and high potency of 1122_67 indicates that this compound should require a less frequent administration in a therapeutic setting.

Example 10 Compound Stability to SVPD

Methodology: 3'-exonuclease snake venom phosphodiesterase I (SVP) (Art. No. LS003926, Lot. No. 58H18367) was purchased by Worthington Biochemical Corp. (Lakewood, N.Y., USA). The reaction mix for the 3"-exonuclease snake venom phosphodiesterase I (SVP) assay consisted of 50 mM TRIS/HCl pH 8 buffer, 10 mM MgCl2, 30 U CIP (NEB, Ipswich, Mass., USA), 0.02 U SVP and the oligonucleotide compound. The stability of the ASOs against SVPD was determined by performing the nuclease assays over a one day time course. In each reaction mix an amount about 0.2 mg/mL ASO in a totaly volume of 150 µl was used.

The incubation period of 24 h at 37° C. was performed on an autosampler, the SVPD and reactions and the ASO stabilities were monitored in time intervals by an UHPLC system equipped with a diode-array detector and coupled with electrospray ionization-time of flight-mass spectrometry (ESI-ToF-MS). To generate the t=0 h time point, the enzyme was added into the reaction mix, directly before the first injection. Further injections took place at regular intervals over a period of 24 hours.

Compounds tested, 1122_67, 1813_1 and the reference compounds 1100673, 1101657, 1102130, 1103014, and 1102987.

The data is illustrated in FIG. 9. Whilst the three highlighted reference compounds from WO2019/217708 and the 1122_67 and 1813_1 compounds had good stability in the SVPD assay, the 2 reference compounds from WO2019/217708 with the closest sequence to 1122_67 and 1813_1, compounds 1103014 and 1102987 were notably more vulnerable to SVPD degradation as compared to 1122_67 and 1813_1.

TALE 8

| Compounds | Cortex | | Midbrain | | Cerebellum | | Hippocampus | | Pons/medulla | | Striatum | |
|---|---|---|---|---|---|---|---|---|---|---|---|---|
| | EC50 (nM) | Max efficacy (% remaining) | EC50 (nM) | Max efficacy(% remaining) | EC50 (nM) | Max efficacy(% remaining) | EC50 (nM) | Max efficacy (% remaining) | EC50 (nM) | Max efficacy (% remaining) | EC50 (nM) | Max efficacy (% remaining) |
| 1856_1 | 251 | 33 | 77 | 20 | 434 | 49 | 202 | 41 | — | 24 | 103 | 27 |
| 1813_1 | 260 | 22 | 93 | 20 | 347 | 47 | 279 | 30 | — | 22 | 89 | 18 |
| 1812_1 | 307 | 52 | 156 | 28 | 603 | 50 | 233 | 35 | — | 26 | 184 | 32 |
| 1809_2 | 134 | 57 | 153 | 34 | 511 | 50 | 111 | 46 | — | 21 | 93 | 29 |
| 1607_1 | 193 | 40 | 89 | 17 | 120 | 42 | 81 | 21 | — | 15 | 63 | 26 |
| 1122_62 | 125 | 56 | 74 | 26 | 226 | 16 | 86 | 46 | — | 19 | 54 | 36 |
| 1122_67 | 125 | 23 | 79 | 14 | 261 | 27 | 146 | 22 | — | 13 | 88 | 19 |
| 1122_33 | 102 | 47 | 38 | 16 | 166 | 35 | 79 | 24 | — | 17 | 63 | 29 |

All compounds tested gave efficacious target inhibition in the tissues tested and were tolerated at the doses tested. Compound 1122_33 across the compounds tested has either the best or second ranked highest specific activity (lower EC50) in all tissues, followed by 1122_62 and 1122_67.

Compounds 1122_67, 1607_1, 1813_1 and 1122_33 provided high efficacy in vivo in all tissues tested, illustrating a remarkable consistent inhibition of ATXN3 expression across the brain tissues tested. Based on an accumulative rank score compound 1122_67 was consistently either the best or second ranked compound in terms of efficacy of ATXN3 knock down in the tissues tested.

TABLE 10

| Tissue | | Cortex (A1) | | Cerebellum | | Brainstem | | Midbrain | | Striatum | |
|---|---|---|---|---|---|---|---|---|---|---|---|
| | | EC50 (nM) | Max KD observed | EC50 (nM) | Max KD observed | EC50 (nM) | Max KD observed | EC50 (nM) | Max KD observed | EC50 (nM) | Max KD observed |
| 1 week of treatment | 1122_67 | 242 | 88% | 833 | 74% | 196 | 87% | 165 | 89% | 148 | 77% |
| | 1813_1 | 278 | 61% | 966 | 57% | 377 | 85% | 183 | 90% | 118 | 51% |
| | 1100673 | 391 | 67% | 2012 | 48% | 769 | 79% | 279 | 81% | 331 | 69% |
| 4 week of treatment | 1122_67 | 100 | 92% | 365 | 81% | 81 | 93% | 94 | 95% | 46 | 89% |
| | 1813_1 | ND | ND | ND | ND | ND | ND | ND | ND | ND | ND |
| | 1100673 | 199 | 49% | 1229 | 33% | 419 | 72% | 129 | 74% | 130 | 35% |

| Tissue | | Hippocampus | | Spinal cord, cervical | | Spinal cord, thoracic | | Spinal cord, lumbar | |
|---|---|---|---|---|---|---|---|---|---|
| | | EC50 (nM) | Max KD observed | EC50 (nM) | Max KD observed | EC50 (nM) | Max KD observed | EC50 (nM) | Max KD observed |
| 1 week of treatment | 1122_67 | 243 | 75% | 41 | 89% | 39 | 90% | 54 | 89% |
| | 1813_1 | 341 | 63% | 45 | 90% | 36 | 92% | 48 | 91% |
| | 1100673 | 516 | 66% | 83 | 83% | 51 | 83% | 68 | 82% |
| 4 week of treatment | 1122_67 | 89 | 92% | 16 | 93% | Imprecise | 93% | 18 | 93% |
| | 1813_1 | ND | ND | ND | ND | ND | ND | ND | ND |
| | 1100673 | 329 | 52% | 48 | 83% | Imprecise | 84% | 56 | 84% |

SEQUENCE LISTING (1988 sequences)

SEQ ID NO: 1 - DNA, 62130 bp, hsapiens
ggaggagaggggcagggggcggagctggagggggtggttcggcgtgggggccgttggctccagacaaataaacatggagtccatcttccacgagaaagtgagtgtccgcgttcggtggggagctgtctgccgcgcggtggcgggcgtggagcgcggcatcaccgcctctcggagggctgggtggggcccgagtcgcccccatgccgatctcgcccggcgaggggcgacgccgcagcctcccgcctcctcggctcgaggaggggagcatcacctacgcccctacttcccccgcggcccccgccctgggagccgggagggagtatgggcggggccgggggcgtctcgggacacgggagtggggtggcgcccagtgggtttgcttctgcctttctccgtcactttccatcgcttttcggaggattccttcacccctccccaatccttccctctccctagggtctagctagagtcatctctgggacacctccctcaacccctcctaccctaatcctggcagaattaacttttcctcctccggactgctcaattctatattggagtcttccctacacgtagatctttggggtcttgttcgtgtctttcccctgcactaggtccgcgagcctcccgagggaggagaccttggctcgcccactgtagggcctgacatttaggaagtgaagtaggaaacccggcgtgcccctaaacagggaagtcgtcacaagagtttttattacgggatgtttgggtttggtttcttttggtactcccatctttccggagcaggcggccagctttgtttttaggtattaggagtggactgggatgattttgttgtagtctgcctagcctgctgtccctttaactcttccgtgaccatgcacttgaagatactgtttgtgatatgtaaagaaactcctcgtttctctcatactattatccagccatttgtgtgtgagtgaagccttccccaggacagctttggcacatggtatcatgtttcataatagtttcgtgtttggaaagagttgctggtaaggctgttatttaataggaggagcaaagggtttttgttttattaaatacttataaatgatcatttatcccagacatttaaaattcacacacacacaacaaataaagcaaagacaaaagaatacatttaccaaatgtaaatctgtagcataaattttttttaatttttattttaaagatggggtctcattctgtcacccaggcaggtgtgcaatggagagatcatggctcactgcagccttgatctcctaggcacaagcgatcctcccgcctctgcctccagagtagctgggactacaggtgcatatcgccagggccaggtaatgtttttgggagagacggggtctcgctgtgttgcccaggctggtctcgaactcctggactcaggtgattctcccacctcggcctctcgaagtgctgtgattacaggcgtgagccactgtgcctggaacaaattgttaagtacaatgcttttcattgtagaaaacatctcggaaacttttgaaataggctgatgttcagtgggggaggaaggactcagtcgtatagttgtcactaattttttgacttgattgacatgactcgtaaatcatagacaatagagatttggttgcttggctgagtagagtgcgtgaaaaatacacacgtacttttttttttttttttttgagatggagtttggctcttgtcacccaggctggagtgcaatggcgccatcatggctcactgcaacctccgcctccccgttcaagcgattctcctgcctcagtctccccagtagctgagattacaggcgcccgccaccacgcccagctaatttttgtatttttagtagagacagggtttcaccatgttggccaggctggtctccaactcctgacaggtggtccgcccgcctcggcctcccaaagtgctgggattacaggcgtgagccaccgcacccggccatatttttgttattaattttcaaaggctttggtgtgggaccacatttcaacatggaaggccttaaacatgttccacactacttcctgagaattagacaagatttttaacaatattgttacctagttgggacacatttgtactgacccatgggatgaaaaaaagctgagtgctagcctagtgaaaatctacttacccgaaagaaatccctcttagtctgggtgcagtggctcacaccagtgctttgggaggcccagacgggcggatcatgaggtcagtagtttgagaccagcctggccaacatggtgaaaccccgtctctactaaaaatacaaaaaattagccaggtgtggtggcaggcgcctgtaatcccaggtactctggaggctgaggcaggagaattgcttgaacccgagaggcagaggttgcagtgagccgagaccgtgccactgcacttcagcctgggcaacagagcgagactccgtctcaaaaaaaagaaaaggaaaaaagagtccctcttaattatcagcatgtgtataggcctacagatacttcaggaatacctttaccattatcatcaacttgtatctacatagcatgtgaagattcaacaatttagttttttgggcgtcctcaagagtacgcacctataaccatatggcccaattgttaatctcctatacagtccattctgggaatgtttgggcttactgtgccatttttccgttcactgccttcccctctgcaatatacctttaacccttgctaggtcctgggtttggagagccagagaaccaactttggccctaaagaagctgtgtaggtagcaatatctgcctacgaagggccttgcaaccatttcctcttggaaccttggtttcctctttctgagtagtcactttgagtaccctttattaagttagaatgtaaaaacagtttctcactgatatatctgcagtgcctgagagagggcctggcacagagtaagtactcaataaatatttgaatggggccgggcgtggtgagacctgtctctacaagaatgaacaaaattagctgggcgtgttagcacatgcctgtagacttgggaggctgaggtgggaggattgcatgagtctgggaggtcgaggctgtagtgagccatgatcgcaccactgcactccagcctaggggacagagcaagatcctgtctcaaaagaaaaaaatgtatatatttgaatggataaagagatggctttgagtttctgagatatatatggtgctgtttatctaaagtaaacaagttttctgtaaatattttaaggctttgcaggccagctgtagtctctgtcacacattcttatttgtgcatgtttttcccaaccatgtaaaaatgtaaagtgcattcttagctactggggcaggttgaatttggcccatgggctagagtttgccaacccctaacttaaacctttgtactaactttatgaccactactggatttttgttgttgtttgttttagttctggtgcctgctttgtttttttttttttttttaatcctcttgctgatgtttcttggtgcagttactgtgccatttgtattggtgcttttaatgtaatgcaaactggtaataatatctaaacttgctggggttgtacataaaattattgaaaagattgaaaagatgctgagcattgactctgtggcattcattatgcccttttgtgattgctggattttagccatctttaggacatttgagctttaggagaagccaaattctgtataaatgacttgaagtgctaatagcacaggttttgaaacctctgcctgggtttgagtctcagctctgccttttactacctgtgtgatcctgagcaagttacttagtatccctgtcctctagtttcctcctctgtagtgtggggataataacatagacataacctgagagttagagtgtagagaaggctccctggcagatagtgctgtagaagtactggccattgccattactcaggtgcttgtgtttgctgaacctcatagtaagggctcggagagcactaagaggaggtgagaaatgctgctagattgacagcttgtccccagatagcccattcccgagagcaccttaggtttatacctgatttgtgttgtagttagtagtgtctctggtaatttgaactagtttcaggttggtcttgaaaacctggggaggttgggggtaaatgatttggtagcagttctcttttgtgattttatacattatctttgtagaactgcagtttgctaattctctgagcccaacacaatgaagtctgggcctaaaatcatagaatttcttttatttttttttttgtttttaatttatttattccctccctccctcctttcttcctttcttccttttctttctttctttccttccttccttccttctttcttttctttctttcttttctttctttggagtctcactctgtcaccaggctggagtgcagtggcacgaactttcttcagagtctcactttgtcaccaggctggagtgcagtggcgcgaactcagctcactgcaacctccgtctcctgagttcaagagattctcctgcctcagcctcccgagtagctgggactataggcatgtgccaccatgcccagctaattttcttatttttagtagagacgaggtttcaccatgttggccaggatggtcttgatctcttgacctcgtgatccacctgcctcagcctcccaaagtgcggggattacaggcgtgagctaccacgcccagcctattttttattttttgaggcagagtctcactctgtcacccaggctggagtgcagtggtgcaatctcagctcactgcaacctccgcctcctgggttcaggtgattctcctgccttagcctcctgagcacctgggactacaggcgcctgccaccacacctggctaattcttatatttttagtagaggcggggtttcaccatgttggccaggctggtctcgaactcctgatctcaagtgatcaacctgccttggcctcccaaagtgctggaattacagccatgagccaccatgcccagccaaatcatgagatttcaataccgctgaactttgattatggcaaagtgaacttctgctttgattaaagcttgatgagagaggtggctggggatagtttgagataagggcaaggcaggaaaatgcataatcttacgtgggctcattgtcattgtacaattcttttggtccatgtggaatttgatccgtcctatgacttaagttatgtttatttttgtttttatttttatttattttgtgtctttttgagagacatgatgttgctctgtcacctgggccagaatacagtggcacaatcttagctccgtgtagccttgaactcctgggctcaagtgatcctcccacctcagcccctcaaacagttgagattatagtatgaaccactgtgcctagccttaagtgatttttaaatttgtactgaacagtttgtcctttccttccattaaatcatattagaagtacagaacttgatatttcctgtagcaatacagtttttctttgatgaagtttgatttcaagtacttatttttcataatttaaagctattttttatagagagaattttaatcaaatatttggatgtcactattgctatatatggtattaagtatggtgaccatagtttgtaaactccaaactgacagcaagacaggaaatttgtgttagcaaaggcttttttcttactgtttgaattttttaaaaattagatacaatacagagaggagcacacaaatcattaagagtacagctcagcgaattttcacacagtgaacatgtgtaaacagcaagtaacaaaagatttacctgcatcctataacctcccattattcccttttctaggtactgtctctccactgcattcccaccaaatataaccactatgctgaattctgacatcataaatgagttttgcctgattttgagcttttgtgactggaagtgtacagtgtatataccctttcgattctgtcctctttagtttaccattgtttgagaaatttatccatactgttccagaattaactactgttaattattgttaattaactactgttgtagttaattcatcctcattgttatctagtattcttttgtgagtaaacacaatttccattctactgtgatcccagctatccatttgggtcgtttccagtttggggtccattacaaatagtaatgctatctgtaatgctattttgtattactacaaatagtaatgctatttgtggcacaaaaatactgcttttgtgaacattcttatacatgtcttttgatgaatgtatgtttgcattgctgttgtttacattatgtacctagtaatggaattgctagatcataggagatgtatatattaagctttagtggatgcattacataattattagttattattggttataccaatttatcctctcatcagtagtatacaacagtttctgtatctctaatctccaacattttagccattttagagtttgtgtactaacacattgtggttttaatttacatttccctgatgactaataaagttgagtacctcttttgtgttctttatagccatttgactgtcttgtgaagtgcttgtttgtcttgcctatttttcttttctttctttctttttcttccttccttcctttctttctttcttctttctttccttccttcttttctttctttctgtctttctttcttgtctttcttgtctttctgtctttcttggtcttgccctgtcacccatgctggagtgcagtggtgcagtctcagcttactgtagcctcgacctttttggggctcaagttatcctcctttctcagcctcccaagaagctggactacaagcacgcaccaccatgctcagttaattttttattttttgtagaaatggggtttcaccatgttgtccaggctggtctcaaacttctgggctcaagtaatcctcctgccttggcctcccaaaatgctgggattacaggcatgagccaccgcagccagccttggctatttttcaaaaggatataagtagaacatctgtatatcccttcaatttgcatattattcagtaagagttgcactctggtagtagaaatatataaggaggagaaagaagtggaaacaaaaagtctattctcatgagaagacttgggggatagtgttctctctagctccaagctacttattccttacgaaaagttgaagataaacttatctcagactgaggctgtctcaatgttgtcttcctattccattatacacatataacccatatttttttcaccagctgaattttgctcctagaaaattgattcatcaggaaaaatatccgtcttgcaaggtggttctctttagagtctgctgtgtgacatagctcaggacaaattgtgtgatgtcagataggttgggttaaggaatagaccttattggggaaagagagaacttggagggccaaggttagcaggagaaggaaatgttctctcatctgccgtcaattcagggaggggcaaacctggtgtctgtgttcacagggagggatccatccatctgtgattctcccttcttatcaggtagcatgggaaagctacactgttgcggggaggagggtcacacgcaggctacttagtaccaggcaccctggacttggattcaggttgccagttgtgtgagaaactgcccagcacctgaaggccctgaacccatgagaagttgtacctacctcccatgaggaggaatcctgtcatcccatgggagctgagcttgggtgcagtccctcttgctggcttgtccaggagtgagctccagggttgtttgggacagttctgctcattgctttacactgtgtatacattatctgtagagttccatgaagagaacttcagcactgtaactgcaagttttaacatggaacagaatttttctcacctgtattaattcttaagatttgaagttctatcaacaagcatttagattgtgtggagatttttttatttttatttttggagacagagtcttgctctgttacccagactggagtggcagtggcatggtcttggctcactgcaggctctacttcctgggttcaagcgattctcatgcctcagtgtcctgattagctaggactacaggtacacaccaccatgctggctaatttttgtatttttagtagagacgaggtttcaccgtattggtcaggctggtctcgaactcccagcctcaagcagtccacccacctcggcctcccaaactgctgggattacaggtgtgagccaccatgcttgactgacatcatcatgttaaaagaataaatgttctagggagctgggcacagtgtcatgtttctgtagttctagctgctcgggaggctgaggcaggaagatcccttgagccctggagttcaagtccagcctgggcaacatagtgagatctctttttttaaataaataaataactgttctagggactaaaatttcctttcaccattagtaatttactgtagaatctccaagaatgaacttattttaggtactgaaaatgagggagactaaatgttttatacagtagtttttagtaaaatatgagatttgatgcatttgatagatgatgtttgtttaaaataattcttaaatttttgatcatgtaattatagtttcattaatggtagatttgtaaaataaatgttaccaaatgaaaatgcatgtacctatgttaattatccttatctaaagctgaaagttcagttcaactatgttaaaacatagtaggggcctggcagggtggctcttgcctgtaatcccagaacttagggaggccaaggtgggcagatcacgaggtcaggagatcgagaccatcctggctaacattgtgaaaccgtatcgctactaaaaatacaaaaaattagccgggcatggcggtgggcacctgtagtcgcagctacttggtaggctgaggcaggagaatggcgtgaactcaggaggcagagcttacagtgagccgagatcatgccactgcactccaggctgggtgacagagcaagactccatctcaaaaaaaaaaaaaaagttggccaggtgtggcggctcacacctgtaatcccagcacttttggaggccgaggcaggcggatcacaagatcaggagtttgagaccagcctggctaacagagtgaaaccctgtatatactaaaaatacaaaaattagccaggcatggtggtgcatgcctgtagtcccagctacttgagaggctgaggcaggagaatcacttgaacccgggaggcggaggttgtggtaagctgagattgctccactgcactccagcctggacaacagagcaagactctgtctcaaaaaaaaaaaaaattaatgattaaattatttaggggagccgggcgcagtggctcacgcctgtaatcccagcactttgggaggccaaggcgggcggatcacgaggtcaggagatcaagaccatcctggctaacacaggatgaaaccccgtctctactaaaaatacaaaaatttagccgggcgtggtggcgggtgcctgtagtaccagctactcgggaggctgaggcaggagaatggcatgaacccgggtggcggagcttgcagtgagccaagatagcgccactgcactccggcctgggtgaaagagtgagactccgtctcaaaaaaaaaaaaaaattatttaggggaagatactatacaattctgtttaacaagtcacattttaattttttcttttggaaatattagcaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacaggtactgattttaaactcactaagtcacatttcttttttttttttttttttgagacggagtctcgccctgttgcccatgctggagtgcaatggcgcgatctcggctcactgcaacctctgcctcccgggttcaagcgattctcctgcctcagcctcccaagtagctgggattacaggcacacggcactatgcccggctaattttttgtatctttgttagagatggggtttcaccatgttggtcaggttggtctcaaactcctgaccttatgatccacctgtcttggcctcccaaagtgctgggattataggtgtgagccaccacacccggcttacatttcttttaaaaatgtggataccatttagaaaaggatgggccattcttcctatagggatctgactggtgaattataactgtgctgttaactttggaaatgggaatgcacaagatattgttttaaatatgcacgctaatgacagtttgtatccttctttccccacccccacccttgcttcaactacctgtcaaaattaacagcagccttctggaaatatggatgacagtggttttttctctattcaggtaagtagtcacaagcatgtactatgtgttgcttacatcccaggcaccgtttcacagcctttcaatagtcactgtaacaaggcgaccttcggaagttcttctgtctacagagtatagattatactctagagtactagattttttttttcttgagacagagtctcgttctgtcacctaggctggagtgcagtggcgtgatcttggctcactgtagcctctgcctcccgggttcaagcgatcctcctgcctcagcctcccaagtagctgggattacaggcacccgccaccacaccagttaatatttgtatttttagtagagatagtggggtttcaccgtgttggccagtctggtctccaactcctgacctcagcctcccaaagtgctgggattacaggtgtgagccactgcacctggccaactagagtactagatttttatatagataaacatgaaaggattgtagaatcttcatattagagtggggcatttaaaaattccttcttgagaaagattaatttgcatctggatgctaataataaccttaattctggccgggcgcggtggctcacacctgtaatcccagcactttggggaggccgaggtgggcggatcacgaggtcaggagattgagaccatcctggctaacatggtgaaaccccgtctctactaaaaatacaaaaattagctggacgtggtgacacgtgcctgtaatcccagctactcgggaggctgaggcaggagaatcgcttgaaccagggagtcgtaggttgcagtgagccaagatcgcgccactgcactctagcctggtgacagagcgagactccatctcaaagaaaaaaagaaatccttaattctaataagtcacaatgtctcaaacttaccatctgttgggtaaatttgagaaaatgcaataccttgctaccatccttttaaatcagcctaccagactggatttccttattatggtttgtggcttttgattttttttttttaatgtatagctctctttgaattctttggtggttatatatatatgtactcgcaagattcttttatctgtgggtctttcattctttttctaacactgtgagttgtatccagagtactttcggaacctctcctgagcgacctatctctgcagatatctttgtttatgtttcccttgtactgccctcctggactcttcctcatccaccagcatttccatctagtgctttaccgtgccactgctaacaggtaatggctactgcagggctgaaatcagaggccagagtaggcccagcacttggcgtttcctatttgtgccttgctgctcttggtgcctgttcatgtgtgcccactaccttgcactcaatttctgtctttgctggtacctggctcacttgcttctttgttggctaccttggagggcagatagtgaattttcagaaatttccctttttttgtcagacagattgaaataaacaggtttgcattttgttttttctacaagcggcaagcccatgaccctagaagtctgacatctatggaaccttcagtttaaatgcccagggagaacttattttggtagatatgatttctgacattgcaggtagcaagttgaatataatttttctaaagtagcacccacagcagccaaattatcagatgtatatagtagactagttttaagaaaagcacttatgggtagaatatacatctggatttttgaggcagttttatttaggaattgtgtggttttctggaacatctcagagacctggtatgaaaagcactcttctaatatatatgtgtttttttttatggatttagtgatatatctatacacacacactttttaaaacctatagccggctgggcgtggtggctcatgcctgtaatcccagtactttgggaggcccaggcgggtggatcacaaggtcaggagattgagaccagcctggccaacaaggtgaaaccctgtctctactaaaaatacaaaaatagctgggtgtggtggcgtgtgcttgtaatcccagctactcgggagcctcaggaggagaatcgcttgaacctgggaggcggaggttgcagcgagccgagatcgtgccactatactccagcctgggcgacagagcaagactctgtcacaaaaaaaaaaaaaaaaacctatagccttctagagaaatttatatatgaagtacacaactaacatagctacacttcctaaatttggaatggagtggtttagcttatgaaaagttgctatttttcttaacaggttataagcaatgccttgaaagtttggggtttagaactaatcctgttcaacagtccagagtatcagaggctcaggatcgatcctatgtaagattctgttttgcatttcatacatttcttttcccaaatttgatttttaaagttgtaatttcttaaagaagagaaatacattttgaatacttttgttttgatgttccctgtttcattcactcagactttcctatttcacctttgtgatgtccatgagcatctgccctgtagccttcctggcaccccagtgtctgtggcagcacagagctgaccccataagtggtgcatgaggccatcttgtggcacagcatcactaagctgctgcagagacgttcatatggttgtgtgatcttttaaaaacatcagtgacacttaactataaatataatcttaaattatcacaaattttatataatatttgccagtagacaacataaatatgaattcaatatttcaagttaatattgtctgttttcttttttagaaatgaaagatcatttatatgcaattataaggaacactggtttacagttagaaaattaggaaaacaggtaacatttcttacccttccttgtctttttttcttatattgtaccccatttaaaactaaaatgtgggccaggtgtggtggctcatgccaacagtttgggaggctgaggtggggggatcacttgaagccaggagtttgagaccagcctgggcaacaaagggaggtcctgtctcttaaaaaaaaaataaaaataaaaataaaaataaataaaaaaaaaaacaaagagccaggcatggtggctcacatctgtaattccagcttacttggaaggctgagtcagaaggatcacttgagctcaggagtttgaggctgcagtgaactatgattttgtcactgtaccccagcctgggtgacagagtaagactgttctataaaacataaaaataaaaaaaatatatttaaaaattaaaaaaaaaaaaggattgctgactttaaaattaggaaactgaccagtaatgtgtgtgtgtgtagcatggtttatccttcttgatagatagaaattgtcattttaaaagataatatcagttttccttataaatttatttgtgacaagtatatgcaatttaactatatcataagaaaaattctatattaaagataatacaaatgtggttacttttaagtgggtttttatgtgatgactatgttctgtcagttaattattacatttatagatttgtatttagcatagtgctgtcacaaagcctgaaatagtgtcaagcatgaataaagcattcaattatgtttgctttagtgtaagattattcattatgattccaaaagccatgtaatacgtacgtctacagaaaatcacttctattttttaaataaaacatgaaatatgtcttgagcaagctattttaagaaacaatcatttaacgtccttgttattagaattttgaatctttgaaagagggttattgaaaaccagctaggacagtaaaaaagaataaactagtgatacatgcagcaatatggatgaatctcaaaataattatgctgaaagaataacccacaaacaaaatactacctgctgtatggtatcatttattaaaagtctagaaaagtgcagattcatctgtagtgatggaaagcagattgaccagcggttgcctggggacgagaaggctatggaggagtgagaggggagggttacagagaggcacgggaaacatggcaatgaggaatgtgttcactatcttggttgtagtaatggtttcatgggagtacagtatacaaatgtgaaaacatttcagaggccagatgcagtggctcatgcctgtaatcccagcacttttggaggccaaggcaggaggattgcttgagctcaaggagttcaggaccagcctgggcaatggcacaagaccccatctctaaaaaaaaaatgaaagaaaaaaaaattggctaggcgtggtgatgcatggccgtagtcccaggtgctagggaggctgaggagggagcacagaggtcaagcctgcagtgaatcatgatcgtgctactgcactccagcttgggtgacagaaggagatcctgtctcaaaaaaaaagtttcaaattatacactttaaatatgtgcagtttattatatgtcacttataccccaataaatctgttttttttaaaatgtaaatacaagccaaaaaaggtataagtcaagaaaatatattgaattaaatctgtaagagataattcaaaaacaaaaaccctattgttatcttttaagtcacccaaatcaaatttgggaaaagtcacctacttagcttcatcctaagttggttctttctttctttctttccttcttttgagacggattcttgctctatcgcccaggctggattgcagtggcgggatcttggctccctgcaacctccgccacctgggttcaagcaattctcttgtctcagcctcccaaatagctgtgtctacagccacgcaccaccacacccagctaatttttgtatttttagtagagacggggtttcgccatgttggtcaggctggtcttgaactcctgacctcaggtgatccgtccgtctctgcctctcaaagtgctggggttacaggcgtgagccaccatgccgagccctaagttggttctttcttaaagttcttcctgaggagccaagagcaagttaaggagatgtaacctagaagcttacagtggaggctagctgggtgcagtggttcacgcctgtaatcccagcactttaggaggctgaggcagggagatcactgaggccaggagcttgagagcagcttggcccaacacagtgacaccttgtctctacaaaaaaaaaaaaaaaaaaaggcagcttacagcagtagaggctgatgcgagtgggaatcacctctaggtaaaaaccagtgtagcgtactgctgagattatttaacctctgggttttatttatgtgtttttaaaaattatgatccagtattttttacttttttttgtataaagtaagcactgaatttttaaggttgtattaatttgcaaataaatgtctatcttattattttgagagatttaaaaaattttagttcttcaaaattgcattttcacattttgaattacgttatctttgacaaatacagaagatgtcaaattttggtttattttctttggttctaatttatatttttgtttaaaactatatttttcactatagactctttctgtctctcgaggtccctgtataatgaaaaagaaggctggaaaaagtattaacattgtcaaaatccaggaaaagtagttggtcatgatattgatcgttaactttagaaactttttgtatcttgtgggttaaattaggattactatgtggtagtgataaatgatgttaattagggccgagtgcagtggctaacacctgtaattccagcatgtagggaggctgaggtgggaggatgtcttgaatccaggagtttgagaccagcctgtacaacatagtgtaagaccccttctccacacaaaaaaattagaaaatttgtcaagcatcttggtgcacacctgtagtcccagctgcttgggaggatgaagcgagagaatcacttaagcccaggtgttcgaggctgcagtgagctatgattgcaccactgcactccagactagatgaccatctcttttaaaaaaatgtgtttatatgttatatgtgatagtgctttttaaaaacatttttaaattatagagacagggtctcactatgttacagcccaggctggtctcaaattcctgggctcaagcaatcctcccaccttagctaacctcccaaagtgctcggattataggcatgagctgcatgcccagctaatttagtgatttttaaaaactgagctggtaattataaattctcttcctggaacttctgactttctcacaattggaatcttttgacaaaaattatcagtaatgggaaaactttgtgtagttgtcatttttcctcccatcagtgtgatagatatgattggagttatgttggactgatattttgaaaaaagatttaattatagctattaataaagacatttaaactactgactatgcatttttattcttttgggagggtttaatgtttatagtttaaagcaaactgttgtttttaaaaaagtatctaacagggccgggcgcggtggctcacacctgtaatcccagcactttgggaggcctaggcgggcggatcacaaggtcaagagatcaagaccatcctggctaacatggtgaaaccctgtctctactaaaaatacaaaaaaatagctgggtgtggcggcgtgcgcctgtagtcccagctactcgggaggctgaggcaggaggatggcatgaacccgggaggcggagcttgcagtgagccgagatcgcgccactgcactccagcctgggcgacagagcaatactctgtctaaaaaaaaaaaaaaaaaaaaaaaaagagtatttagcagaggccaggtgcagtggctcatgtttgtaatcccagaactttgggaggctgaggcgggcggatcatttgaggtcaggagtttgagaccagcctggccaatgtggcaaatgtgctgtctctaactaaaaatacaaaaattagctgggtgtggtggtgcagacctgtagtcccagctacttgggaggctgaggcaggagaatcacttgaacctgggaggcagaggttgcagtgatccgagatcatgccactgcactccagcctgggttacagagtgagactcttctcaaaaaaaaaaaaaagtatttaatagtgataaatctgcagtattctcttgtagtttttaagatcatattattcagtcaaagaaaagagctcaacttgaaatatttccagagtttaaacaatcttactaagctttgatgggttgtatctattcttaacatgtgaaacttccttattacctataatatacactaacttaaatattgacaatttttttccagtggtttaacttgaattctctcttgacgggtccagaattaatatcagatacatatcttgcacttttcttggctcaattacaacaggaaggtaagtaacggctgaacattttgtaatgttacctttcgaagtagttaaataaccaggcacattagatgacagtgtgataaaactgtttttctggcagtggcagtgaaacaatctttagttttgacgtggtgataggctgtgatttgggtgacgctgttcagttagagttctcactgacacctggcccttcctcttctgaggatgctgctttctttgcagcccttctaagtaatggctttttcttttatacatcacatatcacacggctgagaggagggatagatgtttttcttctttgcctcttctaggccactgttcttccttataaactccagtttctttgaaatacatgcccctaacggctgggcacggtggctcacgcctgtaatcccagcactttgggaggctgaggcaggcggatcacgatgtcaggagatcgagaccatcctggctaacacggtgaaatcctgtctctactaaaaataacaaaaaattagccggggtgtggtggcggacgcctgtagtccgagctactcgggaggctgaggcaggagaatggcgtgaacccaggaggcggagcttgcagtgagctgagatcgcgccactgccctccagcctgggcgacagagcgagactccgtctcaaaaaaaaaaagaaaagaaaaaaaaaagaaatacatgcccctagattaaactatcccttgtccttttgcactcatccacaagtctcttttcatcagtgattttaggatctgactcgttgtctttttctctacttcaactacttttatcattcttaattatttctgtatcgtcaatcaatccagtacctgcctcttagtttcaaaatcacttactcttgcttagctattaccagtaatcataaccactgtcaaatctcaattgcaagcatattactctttaactaccacctcctatctttaaaccatgttttgtctgtttttttattccagccattctttaaaccctactgtggggcccaagcatttcctttatacgcattcttcctttcttctactgcttattttctgtaatccgtcatcataatcactccattgcattcttcaacgtgtttcccctctctccctccatcatacttgaatgacaaaaatctcaaccctggttaaaccacatcttggccttgtccattcctgtaccagagtagctggacgtggctaaaaaataacataaaacatgatgattggttttacttttttcttaaatgatctatccatccattcacccatccatctatcaaagtgactaggcctatttctgaagcccaggctggagtgcagcagcataatcacagctcattgcagctccaaactcctgggctcaagtgattctcttgccttagcctgttgagtagctgggactacaggcttgtgctaccacacctagctaaggttttactttaaatttattataatcacaaaattcagatgagcctttagtgctgtctgatatttctactatgttttcttagtgatgtaccaccctccaaggtgtttataaaaaattatgtaccactctccaagaagtttataaaaaataatgtgccaccctccaaggtgactaatttcacagcttatgtctttaaacctttaagcactttcctctcccttacacaccttccttgtggctttccgttacattctgctgagaacatagaagcaattaaaattatgttctttctaccagcaaatttatcaatttgcttatatcttcacctgtgctttgagcctatttaaatagatgaatggtcccctacctctaaccaaaaccagtccctcacttgtgggctggatcccagctcttctcacctactcaagatgttcctgctttcatctctccactctcttatataatcagttccccccccctttttttgtaatattcctataagcagtaaaataagctttttatttccattgattaaaaataaaaatcctctcttaattccatgaaactccagctgcctccccatttttattttttccttaggattgtctctagtgtgccttctccttttcttgaactctgcctcctgggttcaagcgattctcctgcctcaacctcccgagtagctgggattacaggcgtgcaccaccatgaccggctaattttttttttttttttttgagatggagtttccctcttgttgctccggctggagtgcaatggcgtgatctcggctcaccgtaacttctgcctcctgggttcaagcgattttcttgcctcagcctcccgagtagctggatttacaggcatgtgccaccatgcctggctaattttgtattttagtagagatggaaggggtttctccatgtttgttaggctggtctccaactcctgacctcaggtgagccgcccacctcggccccctaaagtgctgggattacaggcatgagccactgcgcctggccccggctaaattttttttttttttttttgtatttttagtagagacagggtttcaccatattggccaggttggtctcgaattcctggcctcgagtgatccacctgcctcagcctcccaaagtgctgggattacaggcgtgagtcaccttgcctagccatcttttagtaatggtatttggagatcacaatttgagtgctggcatgcttattgctgctgggtttgttatgtagttattgtgaattcacatttaggaatatagggtttttaattctttgattttagatacttgtatcttttttcttttatatttaaaaccttggttcctgatgatatcccttcttagaaaccctgtctacctttggccttcagcccaccatgctgtggttttcctaacttgctgcctgcacttttcagattcctttcatggatcttaaatatcatctgtaaataagatctatgtgtcaataattaccaaacttttatctttagtcttgacatctaccctgaacacctagctttgactaactcctagctttggcatctccacttggaaatccaaaaagtgtttcaaactgaacatgtctatgaaagacttatttttttctctctatccatgctatccatcaggttttccatttccataagggtgactcttgtactctggttcctatatattataccgacagagcagcccagagtgcttcttaaccagtgtaaggcctgttatgtcccaccctcactctttgtccttcagtggcttcccagcacacttagaataaaatctgaagtcttaggccgggcttggtggctcatgcctgcaatcccagcactttgggaggatgagggggcagatcacttgaggtcaggagttgatgagaccagcctggccaacatggtgaaaccctgtctctaccaaaaaatacaaaaattaactgggtgtggtgttgtgcacctgtagtcccagctactcgggaggctgagataggagaatcacttgaacccgggaggcagaggttacagcgagccaagatcataccactgcactccagcctgggtgacagaacgagactctcaaaaaaaaattaaaaaaaaaaaatatgtgaagtcttgaataaaacccaagatctttaccatggcccctgaacagggcagagtatccattcttcagacactcttcatagaataccatggtgagctggcatatttattatacaatacagaaacaattttactggcagaaaacacattaaaccgtctaaactctgaatacagttgtcctcataaaaaatgttcaacatactattttgaggttttccattaatagttcttataatctttgtcccattatgtgttaatccaacaaaggatatccaataacaaacaccaaagtttaagaaaaatgtgctaggcgcggtggctcacacctgtaatcccagcactttgggaggccgaggtgggcagatcacctgaggtcaggagttcgagaccagcccagccaacatggtgaaaccctgcctctcctaaaaatacaaacattaactgggtgtggtggtgggtgcctgtaatcccagctactcaggaggctgaggcaggagaatcgcttgaacctcctgggaggcagaggttgcagtgagctaatattgcaccactgcactccagcctgggtgacagagtgagactccatctcaaattaaaaaaaaaaaaaaattaatgatagagaaacttaaatcagttagattgttttaggtatagcccatccttggtttttgtgtgtagcatctagcttggggaaaccctggatttctggaatcatatttagacacagtcacactagactaatgtaattcttttgggatgcaaaccacacgtttgacaccttaaatagcttttaggtatttggcttcccagcccctatttttagttacaaggggtgtacatgtgtgggtcagggtgggggtagctctttccgcagatgattagttttagccatgttactagttattgcacacattatctgtgtcctcacagcagccctgtgagtaagtgtattagggttctctagagggacagaactaataaggtagatgtatatatgaagggtaatgtattaaggagtatcgactcgtatgatcacaaggtgaagtcccacaataggctctctgcaggctgaggaaccaggaagccagtccaagtcccaaaacctcaaaagtagggaagctgacagtgcagccttcagtctgtggcaaaaggcctgagagcccctggcaaaccactggtgtaagttcaagagtccaaaagatgaagaacttggagtctgatgtttgagggcaggaagcatccagcatgggagaaagatgaaggctcagcaagtctagtacttccacactcttatttctgcctgctttattctagctgagctggcagctgattagatggtgaccacccagtttgagggtgggtctacctctcccagttcactggcttaaatgttaatctcctttggcaacaccctcgcagacacacccagaaacaataatttgtagccttcaatccaatcaagttgataatattaaccatcacaggaaggtactagtatcatatgtttaacagtagaaaccaagacaaatgcagctaggaagtgggagaactgggatcagatgcaggcagtctgattctaaatcagttgctgttacccactctgacaacagtaagtgagtagcctgctcagtcaagtactatattagtagggccctttacagacatatttatttctcacagtcactcaatgagacggctcttccagtcttacaatggagaaagtgaggctcagagactttaagtaacttaccttagacgactttactagtaagtataagaatcattatttggactaaagtctttctgaatcctcagcttgtatttttttccagtgttctgtgctgcctttttatctactagtgttttacatcaattttgaatctctttactaactggttaggttgatttttgccttttttttttaggttattctatatttgtcgttaagggtgatctgccagattgcgaagctgaccaactcctgcagatgattagggtccaacagatgcatcgaccaaaacttattggagaagaattagcacaactaaaagagcaaaggtaaaaatgaggcctgcagtatggaatatatggtagtatttcattatgagaattaaattttcatgcttagattgaatatgtggtccttgtgttgttggcgactctattttggaccttatattttagtgaagtttattagtttaaacttgaatcaactctttgaaatacttaaatatattaacttagttagctggtatggtatattcctagcacttcgggaggctgaggcaggctgattgcttcaacccaggagttcgagaccagcctgggcaacatggcaaaacctcatctctacaaatagtacaaaaattagccagatgtggtggtgtatgcctatagtcccagctacttgggaggcagaggaagaaggatcacctgaaactggggaggtagagactacagtgagccataatcacactaccgcactccagcctggtcgagagagtcagaccctgtctcaaaaaaaaaaaaaaaaagaaacggaaaaaaaaaacttagttggattcaaattgcaacacaatcattatattactagagcttatttgccagaaaacattttaagttttgacttacttaaagcctttacattacaaatgcctttatgttatgtctaaaatagaagattggttgcagttattaccagtgcttttgttctttagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtaaagacattctgatgtgtgttgtattcattgctgaagaattgattccaattattcttagatttcatggaagttaatgtactcttagaggtgttttgacaattactgcagaagcaatagctatatagtgggctttccctttagatttcttataatggaaatcactttttacaacctatattttattaggagtagttatatttttactcctggttattttatttggtttcaacactgtactaacacaatagtaaattgtggttttaatctttgtgggtatcagttgacccttatccaaatcagctgttacataaatatgtgccattagacactatggaagggcctggacagggaatataaactgattttacaaaaacccaacatttattggctatgcaacttaaaccgtaagcccactttggtgggcccagttttttagtgatataaactatcaatagagaaaagcgaaaacatatcccctagacaatctaggcaaagaaaaatgttaagacatagctcaaagtagcttaattaaaagtttgaagtgggttttttgttttatttttttctaactcatatgtatttgcttctactttctaatgaaattatttatcagttgatttccttagatatctaaataaaattgaaatttcattaatgggaagattatttttatcctgaacttttcttgcctctatgcatgcctctgagtactccatatggtgtgcaatcccatttttgattaatagagtcctgctggattagcagggacagaaatcagctttagatttctttcttttttttttttctttctttttttttttttttttttttgagtcagagtctcactgtcgcccagcctggagtgcagtgatcttggctcactgcaacccctgcctccgaggttcaagcgattctcctgcctcagcctcctgagtagctgggactacaggcgcctaccaccacgcccagctaattttttgtacttttagtagagatagggttttgcccttttggccaggctggtcttgaactcctgacctcaggtgatccacctgccttggcctcccaaagtgctgggattacatgtgtgagccaccacgcccagccagaagagtagaatattcttaaagagaaaacgttttaaaggcttactcaaatgagtataaacaaacatattgttgcttgaattggtaaatacagtgattggtttttgttgtgttgtgttttgttttcaggtagttccagaaacatatctcaagatatgacacagacatcaggtacaaatcttacttcagaagagcttcggaagagacgagaagcctactttgaaaagtaaagtagttggtacaagttaaagtagcatgtttaatatttgctttggctattttgtctatttgtaaatggttactgcctgaatcctgtgaatatttgaatgtattttttaaaaatttacagcaaataggacgggcacggtggcttacgcctgtgatgctagcagtttgggaggccaaggcgggcagattgcctgaggtcaggagttcgagaccagcctgggcaacacagtgaaaccccatctctactaaaaatacaaaagaatcagctgggcatggaagcgtgcgcctgtagtcccagctgcttgggaggctgagccaggagaattgcttgaacccgggacgtggaggttgcagtgagccgagatcgcaccactgccctccagactgggtgacagagtgagactccgtctccaaaaatatatgtatatatatataaataaaaataaaaatttacggcaaataacatgaaacaaaaaaaccttgccccaatactggataaattttttaaactgagtgaaggaaaccttataaaatttcatttattaaaagaaaaatgaaattaggacaagacaagaagaatgccaattgatcctttggatgtacttcttgcttacctgattaaccctgcaaaattcctctaccaatcagtacgaaaaacagctttggaggtatgggagcgcattcccaaatagacgtggtagttcatttagctgctcatggccgcttcaggcagtcctgtaagcctgttagcatcaggggaatggatgcaaaccataaatctggatcaactcctaaaaccttaccttgtgcccagccttgtaagtgcttgctaaataggaattccaccatatgaaaatacattcttttcaagtaactatcattcagacttttgtcccccactttttttttttaaagaaaaataaaaggctgggcacggtggcttacgtctgtaatcccaccattttaggaggccaaggcaggtggatcacctgaggtcaggaattcaagaccagcctgaccaacatggtgaaacctcatctctactaaaaatacaaaaattagccgggcatggtggtgggtgcctgtaatcccagctacttgggaggctcagacaggagaatcgcttgaatctgggaggcagaagttgcagtgagctgagataacgccattgcactccagcctgggggacaagagcgagacttcgtctcaaaaaaaaagagaaagaaaacttcatgttaaagattacaagataaataatcagacccactgatcctaggtcagaaaacagagtcatagctcaatctgacttactatttgctgtatttcatccattctgagatgcacatagtttcacatttcaatgtctctgaaattgagaagcatcttacagtcataattgacagtatattagcagcacctataaatattggctcattttacatttgatggtataatgaagaaaatatttacctttttttctgttttgtttttaagtcacaactcagaagtagatgaaggaaaattctgatcagctgacatcctcttaatgtgagatatttctagtctttattcagtatagattaatggctaattatatgttaaatttcaaagtagtgcttattagtgctttttacttttaagtttcaaaattaacttttttattataataaactccaaatttatacaaaagtagaaaaactagcatactcctgtttatgacccagattcaacaaatactagcacacggccaatcttgcttttttttttttttttttttgagatggagtcttgctctgttgcccaggctggagtgcaatggcacaatttctgctcactgcaacctctgcctcctgagttcaagcgattctcccacttcagcctcccaagtagctgggattacaggtacacaccaccatgcctggctaattcttgtatttttagtagacacgggatttcaccatgtcgtccaggctggccttaaactcctgacctcaagtgatccacctgcctcggcctcccagagtgctgggattacaggcatgagccactgagcccggcccaatctcgttttataatactcccatctcccattctttccactgtcccacctgcaagtttggattattttgtaacaaatctcaatcatcatattattctataaccattttaatatgtgtctctaaaatatattagctttatttttaacatagttaaatgctattgtcataaaataataatcataataattaattgtaattctatatcatcaattatctagttaatgtaaaaaataaatctaaggccaggcgcggtggctcacacctgtaatcccagcactttgggaggctgaggtgggcagatcacctgagatcaggagttcaagaccagcctgaccaacatggagaaaccccatctctactaaaaatacaaaaaattagccaggcgtggtggcgcatgcttgtaatcccagctacttgagaggctgaggcaggagaatcacttgaacccgggaggcgaggttgcggtgagccgagatcgtgccattgcactctagcctgggcaaaaagagtgaaactccatctcaaataaataaataaataaataataaaaaataacttaaatctacttaattagaaaaactaacattctaaaaattttattttaagaaatatcaaaattggctgggcacggtggctcacgcctctaatccctgcactttggaaggctgaggtgggcggatcacctgaggtcaggagggtcaggagtacaagaccagcctggccaacatggcgaaaccctgtctccactaaaaatacaaaaattagccaggcatgatgatgggcacctgtaatcccagctactcaggaggctgagacagaagaatcgcttgaacccaggaggtagaggttgcagtgagctgagatcaccccactgcactccagcctgggtgacagagtgaaactccgcctcaaaaaaaaaaaaaagagaaaagaaatatagaaattaaagcatacatggccaggcgtagtggctcatgtctgtaatcccagcactttgggaggctgaggcaggcagatcacttgaggccatgagttcaagaccaacctggccaacatggcgaaagcctgtctctactaaaaatacaaaaaaattagttgggcatggtggtgcacacctgtaatcacagctactttggaggctgaggcaggagaatcgtttgaacccagaggtggaggttgcagtgagccgagattgtgccactgcactctatcctgggtgacagagcgagatactgtctcaaaaagaaaaaaaaaaggctgggcgcggtagttcatgcctgcaatcccagcactttgggaggccgaggcaggcagattacgaagtcaggagatggagaccatcctggctaatacagtgaaaccccgtctctactaaaaaatacacaaaaattagctgggtgtggtggcaggcacctgtagtcccagctactctggaggctgaggcaggagaatggcatgaacccgggaggtggagcttgcagtgagcagagatcacaccactgcactccagtctgggcgacagagcgaggctctgtctcaaaaaaaaaaaagaaagcatactctcacctccttcagtgactgatgttagtattttggcacattctttttctgtgacatatacacacttaccttgtaagtgttgtactcatttcctatgacagtaaatagtctttgtaacaggctgcatgatatttcataaaatgaatggatgtggcataatttatatgtgagccttttgaattctgctattataattaatattgcaatgaacaattcttatattgcctctacacctcaaatgtcttatcatttcttctagtttttctgaggatgtcagattattgggttaaaggatatgaacatttttaaggccttggaacagatttctaaattgctttccagaataattcccatgtgatactttcaccatgtttatttcagacttttttttttttttttttttgagacgaaatctcactctgtcacccaggctggagtgtagtggcatgatctcggctcactgcaacctccgcctcctgagtttaagcgattattctgcctcagcctcccaagtagctgcggttacaggcaagtgcctccatgcctggctaatttttgtgtcttttgtagacatggggtttcaccatgttgcccaggctggtttcgaactcctgagctcaggcaatctgcctacctcggcctcccaaagttctgggattacaggcgtgcaccaccgcgcccagccatcagagtcttttttgtcaaaataaaatggtctaaagacatacatcatagagaaactataatacaaaatttacaggtatatctaagaaaagaaaagtatatttaaagcataaaaataaactgctcttttacttaaaattttttaaaaactggattaaaaatatgaaacttccaacaaattgagcttttttttttttttttttcttttttgagacgaggtctcgcttttgtcacccagtctggagtgcagtggcgcgatctcggctcactgcaacctccacctccctggttcaagcaattcccctgcctcagcctcccaagtagctgggattacaggcgcatgccaccacgtcgggctaatttttttgtatttttagtagagagggggtttcaccatgttggccagactggtctcgaactcctgatctcaggcaatctgccagcctgggtctcccaacatgctgggattacaggcatgagccactgcactcggcctgaactttttatagtagtaacgataattcagtaatgtccaataatgactaagtaagttataacaagtacaatgtcagcaataactagtgctttttagtaaacagggtcaggcaaccttgtacccttttaaaaatgttcgaatatcgatatacctccttcctacttggtggaggattgattgaggaggaaagtgtgcagtgatggttaccagcttcagcctcttggcttgactttgcaaatactggtgagaatttggaaagagcttgagaatatcttacatagtcacatgttgctgagaagagttaagaactaacttcttgatgttcatttttaacaatggcttgcattcaaaaccttgtagagctcattagtaggagctaagaagctaatatttgcctttcactaaaattcctgattacttagcctaggtagttcgttgtctctctaggttctgtctttgggagcttgggtctaaggttatcaagctaactctttcttccctctcacccttcccaaattgaccctggtgctgatttgttattcatacgattttctagtttttcttttccctttttgagtatttgaagcttcatactgaatatagtaatcatagtattcatgcataaagaaaatcataaagtaattgcataaatgcataaagtaatcatagttttcatgcattaaaaaaactagttttggctgggcgctatggctcacgcttgtaatcccagcactttcggaggccaaggcaggcgaatcatctgaggtcaggagttcgagactagcctggccaacatggcgaaacctcttctctactaaaaatacaaaaaaattagccgagtatggtggcgggcgcctgtaatcctagctatttggcaggctgaggcaggagaatcacttgaacctgggaggcagaggttgcagtgagccgaggttgtgccattgcactacagcctaggcgacaagagcaagactccatctcaaaaaaaaaaaaaaaaaaaaaaaaactccctattacagattcataatttatgagtcattaaataatattttcaagccatgacattttttccagcagtagtctctaaatctgttttaccatcataaaaccccaagcaaaactctactacatcagctgtgtcactgtaaaacctgccttaactcacagaagcatgaaattaagcaatgtgtgtgaaactattttataaactgtaaagtattccatacatacatgttggcagttattaatgtcttctctaggtgtggctttgaaatggatgcagatgctttctgttacaaaaaacataagttgcaaatgttctataacaaggagagacacaaatatcttcatggacatggattgctatgagtgtttgattgcctaatacttgagccaccacttcagtgatatggtataatttatcaaacagtgttgagaaacagaaactactggggatgttttaaagaggaaaatacttaatatagaaattaggggtttacataatcttaagaaaggatgaaggtgcagctcttagccaggcctccacagtaccacaaaccaacttgcaggaagagctgtaaccactgccccagttgggacaatgggtaatgaggatattaaatttaagaacatactgctatagcaatgatccttggcatagaaagctgccaccacaattgcctagagatgggaacatgaagtctggcccccattgcaacagcagtgaagcagaattttgggactggcatctcccaaatggctttgcttgccaccagagaacaaccaaagtggagggagatggctaggcctcatttctgcctattttattttattttttgagacggagtcttgtctgtcgcccaggctggagtgcagtagtgtgatctcggctcactgcagcctccgcctcccagcttcaaacaattctcctgcctcagcctcctgagtagctgggattacaggcacccgccactgtgcccagccaattttcttatttttagtagaggtggggttttgccacgttggccaggctggtcttgaactcctgacctcaggtgatctgcccgcctcagcctcccaaagtgttgtgattacaggtatgagccaccatgcctggcccatttctcccttttttttttttttttttttttgaggtggagtctcactctgttgcccagactggagtgcagtggtgcaatcttggcgcattgcaacctctgcctcccagtttcaagcaattcttctgcttcagcctcctgagtagctgggactacaggtgtgtagcaccacacctggctaatttttgtttttgttttgttttttttgagacagagtctcactctgtcacccaggctggagtgtagtggcatgatctgggctcactacaacctccgcctcccgggttcaagcaattctcctgcctcagcctccagagtagctgggattacaggtgtgcgccaacacacctggctaatttttttgtatttttaatagagatggggtttcaccatgttggccaggctggtctcgaactcctgacctcgtgatccgcccgcctcggcctcccaaagtgctgggattacaggcatgagccaccgtgcccagacaaggtttgtatttttagtagagacagttttgccatgttggccaggctggtcttgaactcctcacctcaggtgatccgcctgccttggcctcccaaagtgctgggattacaggcgcaagccactgtgcctgacccgtttctgctttttaaagctcatgtgagcacttaatttgtaaccagaatcctacttgtaaaataatctaagacatgtagcttttagctttgtaacctctataatattgatggcacagtgggagtggatgctgagtaccacttgaacatgttccacctcagtgtcttcacagctggaaggtgtctacattgtttcaaggtggacaattgatttacttctcatttttcataaactaaaagtagaataaaggctattcctctaaaattgctatctcacctgtcactcccttgcattctcacataccttcttgagtggaggggcagagggcatggagtgatagcagatgtgccaggaattctccataactcagtccgtccctcttgtgctatgttgcagcatcaggatttgctaatgggaggatactgcccttacgtgcatcattagccatgcacactaaggtcttacacctacacacaggtcagtattctggctcagagaccaacagggagaaattgcagttctcattagttgaactttctttattgttcacagttttaaaacacaaaattgagaggaactctataaaaaatgtgccattctattaataattgttgctggtaatttaaaaatccttgttccttttcaaattcttatataccttttttttttaaacacttgatcttagccaaaagaccgagaagcaatcttttttttttttttttttttttttaacctatagcttctcactgagattgtcagctgtttgtaagttttggtttttggttttctgtgtttgtatttacatatatgaaatacagattgagtatcccttatccaaaatgcttaagactggaagtgttttagatttggggttttttaggatttgtgaatatttgcactatacttaccagttaagcattccaaatccaaaatttcaaatctgaagtgttccactgagcacctcttttgagtatcatgttggtgctcaaaaagtttctgattttggagcatttggatttctgattctcggatttaggatgcttgacctgtaatttcagatttacataaaagcagaaatagtacacagagctccttatatccttcacccagattccccaattattggcctttctgaaccatttgggaataatatgcagatatgattttccattatgtctcagttgttcagtgtatattttctaagtacaagaatatattcctacatatttacatgataaccgtcatgtttaaacattttaaaatggggatttgtattacattgtttctctttttgaaaaaattacagaggagcttaatgcaatcagtattacttaaaatctgataatgtgtgttaaatagtagttttcatttatttcatttatcaggtgttcagtgaatgcttactatgtaacagcacagttatcagcactggggaaatagatgagtaagataagatttgcactttcattagcttacatgccataaagagggaaataaagagaacaccagatgatgataagtttatgctgagaattaaaatgaagtgatgaaataatgggaatgtcaggtggctacttttggtgggatggtcaggaaaggcatctctggggagataaattttaagctcagacctgagtgaaaagaatgagccagccatggaaacattatgttaactcacatggtagtttgaaatgctttatctgatcaaaggtacttatttttggtgactttcaacaatattaagggtctataaaccaacactcatttgcataagaataactaccagtgaatctttttgtatgataggttttttgtttgttgtttttttgagacagagtctcgctctgtcgcccaggctggagtgcagtggcgcgatcttggctcactgcaacctctacctccccggttcaagtgattctcctgcctcagcctcccaaagtagctgggattacaggtgcctgccaccacgcctggctaatttttgtatttttagtagagatggggtttcaccgtgttgtccaggctcgtgtcaaacttctgacctcaagccatccacccgcctcggcctcccaaagtgctgggattacaggtgtgagccaccactcctggccatgataggttattttgtgatgaaaatacctacctcttaatttgtctgataaatttaaattttatgtctagatttcctaagatcagcacttccatattttaaagtaatctgtatcagactaactgctcttgcattcttttaataccagtgactactttgattcgtgaaacaatgtattttccttatgaatagtttttctcatggtgtatttattcttttaagttttgttttttaaatatacttcacttttgaatgtttcagacagcagcaaaagcagcaacagcagcagcagcagcagcagcagggggacctatcaggacagagttcacatccatgtgaaaggccagccaccagttcaggagcacttgggagtgatctaggtaaggcctgctcaccattcatcatgttcgctaccttcacactttatctgacatacgagctccatgtgatttttgctttacattattcttcattccctctttaatcatattaagaatcttaagtaaatttgtaatctactaaatttccctggattaaggagcagttaccaaaagaaaaaaaaaaaaaaaagctagatgtggtggctcacatctgtaatcccagcactttgggaaaccaaggcaggagaggattgctagaacatttaatgaatactttaacataataatttaaacttcacagtaatttgtacagtctccaaaaattccttagacatcatggatatttttctttttttgagatggagtcttgctctgtcacccaggctggagtgcagtgtcgcgatctcggctcactgcaagctctgcttcctgggttcatggcattctcctgcctcagcctcctgagtagctgggactacaggcgcccgccacatcgcctggctaattttttgtatttttagtagagacagggtttcaccatgttagccaggatggtctcaatctcctgacctcatgatccgcccgcctcggcctcccaaagtgctgggattacaggcgtgagccatcacgtccggccagaaatcatgaatattagtaggtgaaaaataaacacattttaccacctggaaaatgaaaaatacttgagtataatctaaataacaatgggaagtgcagagttactttccaggtctcggtttaaatatgtcttaaactttggccaattagtagtagaagttgagagaaaaagtaactatctgacaaagaaattataagcagaatatataaagaactcttaaaactgaataatcagaaaacaactcaataaaaaggtgaaggatttgaaaagatatttcaccaaataagacatagggatgacaaataagcacatgaaaagactctcagcatcactagtcacagggaaatgcacgataaaaccacagtgagacaccatggcacccctgtaggtatggctttaatgaagaaataaaactgacaataccaagtgttggcaaggatccaagcagctgagactcatatactgttaatgggaatgtaaaagtgtacagctttggaaaacagtttggcatttttttgataaatgtatacttagccatgtgatccagcagtcccaatcatgtatatataaccaaaagaaaagaaaacttaggttcacataaaaacttatatcaaatgcttatagctgaccaggcatggtggcccatgcctataatcccagcactttgggaggccgaggttggcagatacctgaagtcaagtgttcgagaccagcctggccaacatggcaaaaccctgtctctacttaaaatacaaaaattagccaggcgtgatggcaggcacctgtagtccagctattcaggaggctgaggcaggagaatcacgtgaacccgggaggcagaggttgcagtgagccgagatcgtgccactatactccagcctgggtgacagagcaaaactctgtctcaaaaaaaaaaaaaaaaaaaagggctggacacggtggcttacgcctgttatcccggcactttgggaggccaaggctgatggatcacctgaggtcaggagttcaagaccagcctggccaacatggtgaaaccccatctctactaaaaatacaaaaatttgctgggcatggtggtgggcacctgtaatcccaggaggctgaggcaggagaatcacttgaacccgggaggcggagattgcagtgagccaagattgtgccattgaactccagcctgggtgacaagaccaaaactccttctcaaaaaaaaaaaagattatagcatctttattcatcattgcccaaaattacaaactgcctaaatgtagaccttcatttagttaatgaatgcacaaactgtggtatatccaaacaattgaataaaaaaaggaatgaactggtacttttttctattcctcctgtttaagtacagccaaaacacctcaacatttgtataaaacatgagctgggctgggtgcggtggctcacacgtgtaatcccagcactttgggaggctgaggcgggtggatcacctaaggttgggagttcaagaccggtctgaccaacatggagaaaccctgtctcaactaaaaatacaagattagtcgggcatggtggcgcatgcctgtaatcccagcttcttgggaggctgaggcaggagaattgcttgatcccgggaagcgaaggttgcagtaagctgagattgcaccattgcactccagcctgggcaacaagagcaaaactctgtctcaaaaagaaaaaaaaaaccattcagctgaatctcaaaggcagagagaagacagactggctagggaccttggaaccagaggagcagtgtggtggggagtggactggattttctttttgcctcatttatcctggacttggtgctggagaagctatgggttcagaccaagagaaaaccccatgaaaagcctgctctctctagccaaaagaggcaacctagcaagataaaaacctttagataataagcacttgactccagtcaaacaaaacagaataaactggccccattcacccctgtcagcaaaggccaagtgggagccaagatatgtaccccaacctggaagtcataaggtacacttctcccctttcccagccaaggtggtgttagagaaggctgactggggagctgggattctcattccctccaggaggtgataacactcctttcacatggtgtcagtggtcacagggaggctgaacttccacccagtaatacataggcatctctctggctcctatatgggtgatgttggagaagaggccgagtagagaatccagactgttgctgacacccagcagtaacaaggacacctccacaatgtccgtggaggccatgtggagatcagtaacaaggcactgctctccctcccagtcagagagatgtcagtggaggactagggggctagaactcccatgtgcgttcagcagtaatccccatgaccgccactccttgacatcacaggccttgaagaaacctggactttcactcccctctggttgtagcgaggtggcactcccttttccctgttgccagtgctgtgtcagtggaggcttgctaaattggaagatgtaaataagattcacattctcataacataataccccaaattttcaggatttaattgaaaatcactaagctgggcatggtggctcacacctgtaatcccagcactttgggaggccaaggtgggccaaacacttaaggtcaggaattcaagaccagcctggccagcatggtgaaaccctgtctctactaaaaatacaaaaattagctgggcgtggtggcacatgcctgtaatcccagctactgggaaggctaaggcaggaaaatcactggaacctgggagacggaggttgcagtgatccaagatcgcactagtgtactgcagcctgggcaacagagcaagactccatctaaatttgtgtcaggattcccagaaggagatgagaaagggtggggctgaaaaaaattgaggaagaagtcatggctgaaaatttcccaaatttggcaaaagtcagaaacctacagattgaaaaagctgaatgaagctcaaatatgataaactcaaagaagttcacacagagacacatcacagtcagatttctgaacactgcagacaaaaaatgaagatctcgaaattagcaagaaatgaccttacctaagcaatttgaatgacagcagatttcccatcagagatcataaaggccagaaggaaggggtacatacaacattttttctagtgctgaaagacaaaaactctaggctgggcacggtggcacacacctgtaatcccagcacttttggaggctgaggcaggcagatcacctgaagtcaggagttcgagaccagcctggccaacatggggaaaccctgtctctactaaaaatacaaaaattagccaggtgtggtggcacgcacctataatcctagctacttgggaggctgaggcaggggaatcgcttgaacctgggaggcgacggttgcagtgagccaaggtcgcgccactgcactccagcctgggcagttgagcgagactccatctcaaaaaaaaaaaaattatccaggcttggtggtgggcgcctatagtcccagctacttgggaggctgaggcaagagaattggttgaacccaggaggtggaggttgcagtgagccaagctcatgccactgtactccagcctgggtgacagagcgagaccttgtctcaaaaaaaaaaaaaaaaaaaaaaaacaagaaaaaaactctaaacccagagttacatatccagtgaaatatccttcaggagtgaagggaaaattaacgatttgtcttcaggagacctaccctaaaagaatggctaaaggaatttctctaaacagaaaagaaatgataaaagaagtaattttggaacatcaggaaggaagaaagaacaataaaaagagtaaaatatgggtaaacacaatagactttcccctccttttgaattttctaaattgtatgatggttgaagcaagaattatagcactgatttggttttcagtatatatattggaaatatttaaggcattatgttacagatgaaggagggtcaaaggatataaagggaggtaacctttctatatttcttttgtactgatgcaggcactttggaaaataatttcactatttgtttaaaaactgaacataccctgaccatatgacatagcatctatactcctgggcatttatcccagagaaacagaaatttatttattttttttttagtattacactccgtaagtgctgtaatactagcacttagggaggctgaggcaagcagattgcttgagcccaggagttcaagaccagcctgggcaatgctgcacagtcaaaaaagaaaaacaaacatttagaaaactattttaaaagtctttaattgctgaatgcctctttggctaatatttggaagatcattattattatttttcttttttaggcagagtcttgctctgtcactgaggctggagtgcagtggcgccatctcggcttactgcaacctctgcctcccgggttcacgccattctcctgcctcagcctcccgagtagctgggactacaggcgtgtgccaccatgcccggctaattttttgtgtttttagtagagatggggtttcactatgttagtcaggatggtctccatctcctaacctcgtgatccgcccacctcggcttcccaaaatgctgggattacaggcgtgagccactgtgcccagcctggaagatcattatttagtcctacaactgacacattgttccactgacgcaattgcccaggctggtcttgaactcctgggctcaagcaatctgcctgcctcggcctccctaagtgctagtattacaggcttgagccactgtgcccagccaaaaatagaaatttatattctcacaaaaacatgtacatgaatgtttatagcagctttacttgtcataatcaaaaactggaaacaaccaaaatgtcctacagtgaaacaaactgtagtacatccatagcatgtaatactctactgtcaggattaaaaagaaacccactgttggcacaggcagcaccgtggctggatctcaggggcattatgctgagtgcaaaaaagcctcaaagggtcttacactgtatgattccacttgttcaactaaaaatgacagctgtatagagatagagaacatattagtggtttccactagttagagaaagtgggtaaaagataggtgggtgggaatataaatcgatagcagggagatctttgtggtattataacacttctatgtcttgattgtagtggtggtggttacatgaatacacgtgtgataaaatgccatgtagaactacatataacgttgtgccaatgtcaatatctaggttttagtttgatctttagttacataagatgtaactattgggtgaaattgggcaaaagagtacacgaaacctctcttaaatatctttacaacttcctttgaattgacagtttttcaaaatagaaagttgggtttttgtaaatacatgaattgttgatatacacaacaaatctcaaatgcattatgctacgtgaaagaagccatattcaaaaggctacatacctactgatgccttttatatgacgtgcaggaaaagataaaactgtaggacagagaatatactggtggctatctgggattaggaaatggggatcgaccacaaaggggcagcatgggggaattttctggggcaatggaatggttgtgtatcttgatggtgtatttgtcaaaatatatagaactataaaagtaaattttgctttatatgtattaaatcaaaaaaagaaactcgtgctcaaatagaaatacattttctgagaacttgccttttgatgactttgagaattttctggaaattttaaagaaatgtggttttgtttcccaacaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatttaaactattggtatcatttttctaatgtataatttgtattactgggatcaagtatgtacagtggtgatgctagtagaagtttaagccttggaaataccactttcatattttcagatgtcatggatttaatgagtaatttatgtttttaaaattcagaatagttaatctctgatctaaaaccatcaatctatgttttttacggtaatcatgtaaatatttcagtaatataaactgtttgaaaaggctgctgcaggtaaactctatactaggatcttggccaaataatttacaattcacagaatattttatttaaggtggtgctttttttttttgtccttaaaacttgatttttcttaactttattcatgatgccaaagtaaatgaggaaaaaaactcaaaaccagttgagtatcattgcagacaaaactaccagtagtccatattgtttaatattaagttgaataaaataaattttatttcagtcagagcctaaatcacattttgattgtctgaatttttgatactatttttaaaatcatgctagtggcggctgggcgtggtagctcacgcctgtaatcccagcattttgggaggccgaagtgggtggatcacgaggtcgggagttcgagaccagcttggccaaaatggtgaaaccccatctgtactaaaaactacaaaaattagctgggcgcggtggcaggtgcctgtaatcccagctacctgggagtctgaggcaggagaattgcttgaaccctggcgacagaggatgcagtgagccaagatggtgccactgtactccagactgggcgacagagtgagactctgtctcaaaaaaaaaaaaaaaatcatgctagtgccaagagctactaaattcttaaaaccggcccattggacctgtacagataaaaaatagattcagtgcataatcaaaatatgataattttaaaatcttaagtagaaaaataaatcttgatgttttaaattcttacgaggattcaatagttaatattgatgatctcccggctgggtgcagtggctcacgcctgtaatcccagcagttctggaggctgaggtgggcgaatcacttcaggccaggagttcaagaccagtctgggcaacatggtgaaacctcgtttctactaaaaatacaaaaattagccgggcgtggttgcacacacttgtaatcccagctactcaggaggctaagaatcgcatgagcctaggaggcagaggttgcagagtgccaagggctcaccactgcattccagcctgcccaacagagtgagacactgtttctgaaaaaaaaaaatatatatatatatatatatatgtgtgtatatatatatgtatatatatatgacttcctattaaaaactttatcccagtcgggggcagtggctcacgcctgtaatcccaacactttgggaggctgaggcaggtggatcacctgaagtccggagtttgagaccagcctggccaacatggtgaaaccccatctctactaaaaatacaaaacttaagccaggtatggtggcgggcacctgtaatcccagttacttgggaggctgaggcaggagaatcgtttaaacccaggaggtggaggttgcagtgagctgagatcgtgccattgcactctagcctgggcaacaagagtaaaactccatcttaaaggtttgtttgtttttttttaatccggaaacgaagaggcgttgggccgctattttctttttctttctttctttctttctttttttttttttctgagacggagtctagctctgctgcccaggctggagtacaatgacacgatgttggctcactgcaacctccacctcctgggttcaagcgattctcctgcctcagcctcccaagtacctgggattacaggcacctgccactacacctggcgaatatttgttttttttagtagagacgggcttttaccatgttaggctggtctcaaactcctgacctcaggtgatctgcctgccttggcctcccaaagtgctgggattacaggtgcaggccaccacacccggccttgggccactgttttcaaagtgaattgtttgttgtatcgagtccttaagtatggatatatatgtgaccctaattaagaactaccagattggatcaactaatcatgtcagcaatgtaaataactttatttttcatattcaaaataaaaactttcttttatttctggcccctttataaccagcatctttttgctttaaaaaatgacctggctttgtatttttttagtcttaaacataataaaaatatttttgttctaatttgctttcatgagtgaagattattgacatcgttggtaaattctagaattttgattttgttttttaatttgaagaaaatctttgctattattattttttccaagtggtctggcattttaagaattagtgctaataacgtaacttctaaatttgtcgtaattggcatgtttaatagcatatcaaaaaacattttaagcctgtggattcatagacaaagcaatgagaaacattagtaaaatataaatggatattcctgatgcatttaggaagctctcaattgtctcttgcatagttcaaggaatgttttctgaatttttttaatgctttttttttttttgaaagaggaaaacatacatttttaaatgtgattatctaatttttacaacactgggctattaggaataactttttaaaaattactgttctgtataaatatttgaaattcaagtacagaaaatatctgaaacaaaaagcattgttgtttggccatgatacaagtgcactgtggcagtgccgcttgctcaggacccagccctgcagcccttctgtgtgtgctccctcgttaagttcatttgctgttattacacacacaggccttcctgtctggtcgttagaaaagccgggcttccaaagcactgttgaacacaggattctgttgttagtgtggatgttcaatgagttgtattttaaatatcaaagattattaaataaagataatgtttgcttttctatttccttttgaatttgtgtttattgttaattcatagctattcaaagtgtgattagagctgggcttggtggcttgcatctacagttccagctacccaggaggcagaagcaggaggattgcttgagcctaggagttcgaggctgcagtgagctatgatcctgccactgaattctagcctgggcgacaaaacaggaaaaaagtatggatggaggaccagcagcatctgtatcacctgtgagtctttcagaaatgcagagtttcaggctacactcggacctactgaatcagaacttgcactttttacaagatccccaggacactaaagtatagagtgaagcttgagaagcgctgttgtgtggattgttcttaaccagctgcagtgatgaatatgaataacgcaggccagcacagtccattgatattctattccagcttactgcctgccaaaaggtccattattactggatcctcagtcttttccaagagaagctaagaattccaaatttttatttgaaatatattttttaaatgtttgttcaactggcccagtgccagtggctcatgcctttaatcctagcactttgagaggccgaggtggaaggatcacttgaccccaggagtttgagaccagcctgggcaacataaagagaccccatctctattaaaaaaaaatagagacaatgctgccttaaaaaagtcaaataaatgtttgctcaactgatttttaatactgagggccaaacaaagcacatcaaatttttaagtgctgcttttcctcattttatccaactctggacaccagaatccaaatgtagtgattggaatccacctagactgattgaggaatatattgtcctcaaattttatgagggttgactattcattttaactttaattaggattgggcacaaattttgaaacataataacattacaggaccggggcccgatccagaccccaagagagggttcttggatcttgtgcaagaatgaattcagggcaagtccataaattgaaagctagttcattaagaaagtagaggaataaaagaatggctaccccataggtagagcagccctgagggctgctggttgccatgtccacccccgcgccccctccccccgctttgttgttgttgtttaagacagagcttcgctgtgtcatcaggctggagtgcagtggcatgatagctcactgcaacctctgcctcccgcgttcaagcaattctcctgcctcagcctcctgagtagctgggactacaggcgtgcaccaccacgcccagctaatttttgtatttttagtagagatgcggtttcaccatgttggccaggaaggtctcaatctcttgacttcgtgatccacccgccttggcctcccaaagtgctgggatgagccacctcgcctggctggttatttcttgatgatatgctaaacaaggggtggattattcatgcctgccctttttagaccatttagggtaacttcccggcattgccatggcatttgtcaactgtcatggtgccaatgggagtgtagcagtgaggaggaccagaggtcactttcatcaccattttggctttttcagccggcttctttactgcaacctgttttatcagcaaggtttttatgatctgtatcttgtgcagaccttctatctcatcctgtgacttagaatgccttaaccatctgggaatgcagcctagtaggtcttggcctcattttaccaaccccctattcaagatggagttgctctggttcaaatgcctctgatatttccctactcccttttataagaaaacccttaatcctaagggttgcagagggatgaagatccatcttctgtattcttcaggctgaataggggtgatgatattcctgcctatgagagtctcttgtattagggtagagaggagctcagtcagtcagtatggctccctatccttcctcccttccccagcccctgacaactaccattctactttgtctctatgattctaagtatctcctataagtggaatcattcagtatttgtagggtttttttgtgactagtgtatttcacttagcatgtcaaggttcatccatgttgtagcatacgtccaaattttcttctttttaaaaactgaataatattccattgtatgatatatgcacattttgcttattcatttatccatcaaagaaaaccagtagcttttttacataccggcagtaacctggttaaaaaaataagatggaaaataccaagcccgaaaatgtcaaattcttgaataccagacaggtactataatccaagctgagcagagaggaatggcccttgtctcagccctgagccacatgtcactacatgggccccaaggagctcttgtgcccagagtcctgctaaggctcgttcttcacccctctaaagtggctcaaactagcgtaggaggccaggagggagcagattctatgccacctccattgcttccgtgccttctccagatccattttttccaaaagctgtgtttgaattctgcacaggggcatctctgtctccaacactgaaaccccttttgccagacccagagaagatttaactgcctttttttttgagacagggcctcgttctgtcacctaagctggagtgcagtggcacgatcttggctcacggcaacctctgcctcctgggctcaagcaattctcctgcctcagccacccgaatagctgggattataggcgcaggccaccacatccagctaagttttgtatttttagtagagacgcagttttgccatgttgcccaggctggtctagaacttctgagctcaggtgatccacccgcctcggcctcccaaagttctgggatgacaggcatgagccacctaacctggccagatttaactgctttgagccaccgtctcacacatcttccaggagcttctagtcaaatgcagaggattaatagtgtataattccatttacataagatctttggaatagtcaaactcatagagacagaaagtagaatggtggttgccgggggatggttgaggggaaaattaggagttgtttaacgagtatggagtttcagtttgggaagatgaaaaaagttctggagatggacagttgtaatggctgcacaacaacgtgaatgtacttaatgccggtgaaccgtataaccatttaacaactgaaaatggttacaaaattttgtgttatatatatcttatcacaataaaaaatatagaggattgatcactatatttgctcccttccaaaatctcacctaggttaaagtaaagaaaaatatataaacccacaagaacacagggaccaggagaggagatgcattcattggattacgtttggttgtaaaaaaaacaaaaaatcctccccggcacggtggctcacaccttgtaatcccagcactttgggaggctgaggcaggcggatcacgaggtcacgagtttgagaccagcctgaccaacatggtgaaacctcatctctactaaaaatacaaaaattagccgggtgtggtggcgtacgcctgtaatcccagctactgaagtggctgagacaggagaattgcttgaacccgggaggcggaggttgcagtgagccgagatcacgccactgcactccagattaggtgacagaacaagactccatctcaaacaaaaacaaaaacaaaaacaaactaatataacagtgactttacatgctatgggttttttttctcctctcatcttcaagaaatgtggagactgccagtccggggatgatacagcatcacagtgtcaggaatctgctctttctgtataattgttacaggaaaggggtccggatccagaccccaagagagggttcttgaattcagggcaagtccacagtgcaaagtgaaagcaagtttactaagaaagtaaaggaataaaaaaatcgctactccatagacagagcagccctgagggctgctggttgcccatttttatggttatttcttgatgatatgctaaacaaggggtggattattcatgcctcccctttttagaccatatagggtaacttcctgatgttgccatggcatttgcaaactgtcatggtgctggtgggggcgtagcaccaaggaggaccagaggtcactcttgtggcctttgtggttttggtgggttttggccagctcctttactgcaacctgttttatcggcaaggactttatgacctgtattttgtgttgaccttgtatctcatcctgtgacttagaatgccttaaccatctgggaatgcagcccagtaggtttcagcctcattttacccagctcctattcaagatggagttgcagccgggcacggtggttcatgcctgtaatcccagcactttgggaggttgaggcgggtggatcacaaggtcaagagttcaagaccagcctggccaacatggcaaaaccccatctctactaaaaatacaaaaattagccaggcgtggttggtgtgcgcctattatgccagctacttgggaggctgatgcaggagaatcacttggatctgggaggcggaggttgcagtaagcagatatcgcgccatgcactccagcctggatgacagagcaagactccgtctcgggggaaaaaaaaaccaaaatggagttgctctggtttacaggcctctgacataatggctttatgtacatggcttccatggctagggtcagctcatagatctaatatggctgtgttggtgctcatgttgcagcccagcaatcagaaagagaaaggaggctgggtttggtggcttacacctgtcatcccagcatttcgggaggccaaggcgggaggatcacatgagcccatgagtttgagaccagcttgagcaacacagggagacctcatctctacaagaaataaaaataaattagttgggtatggtggcatgcacctgtggtcccagctattcgggaggctgaggtgagaggataccttgagcctggaggtttgaggctgcagtgagctatgatcgcaccactgcactccagcctgggcaacagagtgagaccccatctcaaataattaaaaaaaaaaaaaagaaagaaagaaaaaaaaaaggagagcagaaaaaggctatgtaccttttctttcgggttaccttctcaaagttgtgcatactacttccgtttacattacattggccagaacttaacatgacaactactagctacaaggtggtttttattctgggttgccatgcatcttagcttaagtaccctacaggtcctgagataatgattcctatgaaaatgattatttacttatttaattaatttattttgagatggagtctcactctgtcacccaggctggagatcagtggcgtgatctcggctcactgcaacctctgcctcccaggttcaagcaattctcctgcttcagtctcccgagtagctgggactacaggcatgcgccaccatgcccagcttttttgtatttttagtagagacggggtttcactatgttggccaggctgatctcgaactcctgacctcaggtgatctgcctgcctcggcctcccaaagtgctgggattacaggcgtgagccactgtgcctggctgaaaatgattttttaaaagtgttccaggaggaaatggaaagggcataggggagtaagaaagtggaaataggaaaagaaggaagccaagcaagaggagcctatcaagcaaagcctcagtcctgcagacagtctggaggcaggatattcacatcttagagttgtccaaaacagaacaggcaagctgcataattttcaactctggctgaataaggttgcatttcagctctctgggcacctggaaagtatgggctccagtaacctggaggcagtctgctgactgctggctggtgtgcacaaaagtggtaaagggatgagggagtgcaatatgggcactggcatcttggctgtcatgcatccaggtaaaaagtggaggctcaattactatatatgaaggggagaacagactttggggaacaattagcagtcatttccaggtgagacaacaacagaagagaaatgctaatttttttttttttctttgagatggagtttcgctcttgttgcccaggctggagtgcaatggcgctatatccagctcaccgcaacctccgcctcctgggttcaagtgattctcctgcctcagcctcccgagcagctgagattacaggccaccacacccagctaattttgtatttttagtagagacggggtttctccatgttggtcagggtggtctcaaactcccaacctcaggtgatccgcccgcctcagcctcccaaagtgctgggattacaggcgtgaaccaccgcacccggcgagagatgcgaacattttttttgttttttggaggatgacaagttgatgcaggaatgagcagaaccaggaggctgaatactgagtgttaaagagttcctagcaatatgcaggaaaggaaagcaacaagtatcctgagaggtgggggttagatgtagactgaaatcaggaggtgtggttaaaactctttgaaagaggctgggtgcggtggctcacataatcccagcactttgggaggccaaggcgggtgcatcatgaggtcaggagttcgagaccagcctgaccaacatgtgaaaccccgtctctactaaaaatacaaaaattagccgggcatggtggcgcatgcctgtaatcccagctactaaggaggctaaggcaggagaaccgcttgaacctgggaggcgaaggttgcagtgagccgagatcatgccattggactccagcccaggcgacagagagagatcccatctcaaaaaaaaaaaaaaaaaaaaaaaaaaagaaaggaaaagaagaaaagaaaaaagaaacagcagattccctagagaggagacattcatcactaaaaaaaaaaaaaaaaattaaaataaatcgcagaagtaaaagccctttttgaaagggctcagggtacccagcttaatgtatgaaacaaaagcaaacccacatcaaagcacaccattattaatttcagagcatcagaaataaagagaagatctgacaagcttcttggaagaaaacaaggcatagagaataatcagagtagagtagagcaggaaaacagagtcctgggtagagcgaactgagcctagccaatcgatagaattcttgatgttttgttgaaaacagaagcactttacaattctcttggtaagttttagaaagattctgtagtaatggaaaattgtacaaatttaaaaaatggaatctgttaacttcaggaagaacaaaaggtagaaaaatcaaggcaatataatcttggtacaacatttgacttagctgcaatgaataagacttacatagtcatagaaggtaaacactgattacttactttaccaaaaattatgatatcatcatattgaaagcccagaaggaagggaaataaagggaaatacaagagtgctaaatcttttatttttcaataagttggtaatgtctaaaattaataagaaaatggcaaccataagcctaatgcttagaaattcagaaaagtatcagactaaattttaaagtctactttaaactgagtctttgctttatagttgcataaataaattcattttgatggttttctcagaacagatgaactggctgggtgcggtggttcatgcctgtaatcttagcactttgggaggccaaggccgatggctcacttcaagtcaggagtttgagaccagccaaaaaattagccgggtgtggtggtgcacgtttgtaataccagctactcaggaggctgaggcaggagaatcgcttgaacctgggaggcggaggttgcagtgagccaagatggaacgactgcactccagcctgggtgacacagtgagactccgtctcaaaaaaacacaaagaacagatgaactgttttcctttgaggaatattgatgatcccactgcttgagtaatggaaaccagcttgcagctgatagttattttttgtcttttttcctgttctatccactgtcctaggtttggaatttcagctgggcagcttcgatcccaccacctgtagccactgaggttcacaggctctgtttgaggtgttgtgttagattgtgctgggttggttttgctgcttattgagtgatgaagagcaacatattagctactgagatattttgcagaaaaaggaagagatgtcttcagctcaaatgctatcaaacttgtatgtcttttaactttttattataaaaaatttcaaacatatgcaaaagcaaaagactagtttaatgaaccttatgtacccaccacccagtttcaacaattatcagttcctgacaattcttgtttcacctatcccacctctattatacacacatacaaacacacagacaccacacacacacacacacacacacacacgagagcaaagtcaacttccattattttgaagcacatccaagacatcacatcacattatttatcacattatttattaagtttcttcagtcacagtccatctcacagaaagaaatcccccatgagaaacttttaggacatagcttttatgttaattacttaatttctgcactagccatccttgcctgccttctaattttctgcactagctatccttaccttccttctaattttctaacctgccaaggattctgctgcctcaaggtatttgtttctttctgcctggattgctctttcgcagatacttacatgtctcattctttttcacccaggtgaaataaacagcgttgttgctcacacaaagcctgtttggtagtctcttcacatggacgcgtgtgacatttggtgctgaagacccgggacaggaggactccttcaggagacgggtcccctgtccttgccctcactccgtgaggagatccacctacgacctcgggtcctcagaccaaccagcccaaggaacatctcatgaatttcaaatcgggtaagcggtcttttccatcctctcttgctacccttcaatctccctctctcgctacccttcaatctccctgtccttccaattccagttctttttcctctctagtagagacaaaggagacacattttatccgtggacccaaaattccggcgctggtcacggactcaagaagacagtcttctcttggtgtttaatcactgcagggacgactgcctgattattcacccacactccattggtgtctgatcaccgtgggggtgcctgtcttggtcattcacccacattcccttggtggcaagtcaattgcggggacgcctgctttggctgctcacccacccccttctccgtgtctctacctttctctttaaacttacttccttcactatgggcaacattccgtcctccattcccccttctactcccttagcctgtgttctcaagaacttaaaacctcttcaactcacacctgacctaaaacctaaaagccttattttcttctgcaataccgcttggccccaatacaaactcaacagtagttccaagtggccagagaatagcactttggatttgtctgtcctacaggatctagataatttttgttgaaaaatgggcaaatggtctgaggtgcctcagatccaggcattcttttacacactggtccctccctagtctctgctcccagtgcgactcatcccaaatctttcttctttctctcctgtctgttccttcagtctccaccccaagctccgagtcctttgaatcctccttttctatggactcatctgacctctcccctcttccccaggctgctcctcaccaggctgagccaggtcccaattcttcctcagcctccggtcccccaccctataatccttttatcaccccctcctcacaccgtgtctggcttacagtttctttctgtgactagccctcccctacctgcccaacaatttcttcttaaagaggtggctggagctgaaggcatagccaagggtaatgctcctttttctttatctgacctctcccaaatcagttagcgtttaggctctttttcatcaaatataaaaactcaacccagttcatggcctgtttggcaacaacccttggacactttaccgccctagacccagaatggccagaaggccgtcttattctcaacatgcattttattacccaacccactcccgacattagaaaaagctccaaaaattagattccggccctcaaaccccacaacaggacttaattaacatcaccttcaaggtgtacaataatagagtagaggcagccaagtagtaacgtatttctgagttgcaattccttgcctccactgtgagacaaaccccagccacatctccagcacacaagaccttccaaatgcctgaactgcagcggccaggcattcctccaggactgcctaccccaggatcttgcttcaagtgccggaaatctggccactgggccaaggaatgcccccagcccaggattcctcctaagccatgtcccatctgtgcaggaccccactggaaatcggactgtccaacccggcagccactcccagggcccctagaactctggccaaaggctctctgactgactccttcccagatcttctcagcttagcagctgaagactgatgctgcctgatcgccttggaagccccctggaccattacggatgctgagctttggataactcttacagtagagggtaggtccatcccctgtttaatcgatatgggagctacccactccacattaccttcttttcaagggcctgtttcctttgcccctataactgttgtgggtattgatggccaggattctaaaccccttaaaactcccccactctggcaccaacttggacaacattcttttatgtactcttttttagttatccccacctgcccagttcccttattaggccaagacattttaaccaaattatctgcttccctgattattcctggactacagccacatctcattgccacccttcttcccaacccaaagcctccttcgcctcttcctctcgtatcccccaaccttaacccacaagtatgggacacctccactccctccctggcaaccgatcaaacacccattactatcccattaaaacctaatcacccttacctggctcaatgccactattccatcccacaactggctttaagaggactgaagcctgttatcactcgcctgctacagcatgggcttctaaaacctataaactcttcttacaattctcccattttacctgttcaaaaaccggacaagtcttacaggttacctcaggatctggatcttatcaaccaaattgttttgcctatccaccctgtggtgcccaacccatacacttgtttgtcctcaataccttcctccacaactcactattccgttcttgatctcacagatgcttttttcactattccctacaccactcatcccagcctcttttgcttttacctggactgaccctgacacccatcagtcccagcagcttacctgggctgtactgccgcaaggcttcagggacagccctcattacttcagccaagctctttctcatgatatactttctttccatcccttcgcttctcaccttattcaatatattgatgaccttctactttgtagcccctcctttgaatcttctcaacaagatacttttcaacatttattctccaagggatatcggatgtccccctccaaagctcaaatttcttctccatccgttacctacctcagtataattcttcataaaaacacatgtgctctccctgctgatcatgtctgactgatctctcaaaccccaacaccttctacaaaacaacaactcctttccttcctgggcatggttggatacctttgcctttggatacctggttttgccatcctaacaaaaccattatataaactcacaaaagcaaacctagctgacctcataaatcctaaatcctttccccactcccctttccattccttaaaaaacagccctaaaagctgctcccacactagctctccctaactcatcccaacccttttttcattacacacagctgaaatgcagggctgtgcagttggaattcttacacaagagccaggaccatgccctgtagcctttctgtccaaacaacttgaccttactgttttaggctagcccccacattattcctgataccacacctgacccccatgactgtatctctctaatccacctggcattcactccatttccccatacttccttctttcctattcctcaccctgatcacacttggtttattgatggcagttccacctggcctaatcgccattcaccagcaaaggtgggctatgctatagtagtatcttccacatctatccttgaagctaccgctctgcccccctccactacctctcagcaagctgaactcattgccttaactcgagccctcgctcttgcaaaaggactacatgtcaatatttatactgactctaaatatgccttccatatcctgcaccacaatgctgttatatgggcagaaagaggtttcctcagtacgcaaaggtcctccatcattattgcctccttaataaaaactcttctcaaggccgctttacttccaaaggaagctggagtcattcactgcaagggccatcaaaaggcatcagatcccatcgctcagggcaatgcttatgctgataaggtagctaaagaagctgctagctttctaacttctgtccctcacggccagtttttcttcttctcatcagtcactcccacctattcaccgactgaaacttccacctatcaatctcttctcacacaaggcaaatggttcttagaccaaggaaaatatctccttccagcctcacaggcccattctattctgttgtcatttcataacctcttccatgtaggttacaagccactagcccacctcttagaacctctcatttcctttccatcatggaaatctatcctcaaggaaatcacttctcagtgttccatctgctattctactacccctcagggattattcaggccccctccctaccctatacatcaagttcagggatttgcccccacccaggactagcaaattgactctattcacatgccctgagttaggaaactaaaatacctcttggtctgggaagacactttcactggatgggtagaggcctttcccacagggtctgagaaggccaccacagtcatttcttcccttctgtcagaaataatttctcggtttggccttcccacctttatacagtccgataacggactggcctttactagtcaaatcacccaagcagtttctcaggctcttggtattcagtggaaccttcataccccttaccgtcctcaatcttcaggaaaggtagaacggactaatggtcttttaaagacatctcaccaagctcagcctccaacttaaaaaggactggacagtatttttacctcttgcccttcacagaattagagcccgtcctcgagaagctacagggtacagtccatttgaacttttatatggacgcactttcttgctcagccccaacctcgttccagacaccagccctctaggcgactatcttccagtcctctggcaggctagacaggaaatccaccaggctgctaatcttctcttgtctactccagattcccaactatatgaagacaccctagctggacgatcagttcttattaagaacctgacccctcaaactctacaacctcgatggactggaccctacttagtcatctatagtaccccaactgccgtccgcctgcaggatcctccccactgggttcaccgttccagaataaagctgtgcccatcggacaaccagcctaatctctcttcttcctcctggaagtcacaagtactccccactacttcccttaaagtcactctcatttctgaagaacagtaataacccttatgagcctaatacatcccttcattctattagctctattcatccttaccctactttttgcaacagggctttacacagtcaccccccctacttggactgaaccccaaaaacttgtcatccctactatcttctgtttactcatactcccattcactattctcaactactcataaatgccctaa

SEQ ID NO: 2 - DNA, 62956 bp, mfascicularis
agaatgtaatgatggctttttcttactaaattttcagtggaggaggaggagaaagaaagtaaatagttatatgaacacagtagaaagtacaaagtggaaaacaaaaagagtatcgaacccaggtgagtggtccaaacctccccccagaaacctaagaacccatagaaatgggtgggaagcggagaagatcctccagacagcaggtggcgatgtagcatcccccagaaggccctctaacagaaactaggaggacgcgctaccaaggtcacgtgtccccggcgttcactcgctcttcgcttcacgtgactcgcatcctcgcgggtgattggcctgcgtgcggcacgtgggcggggggaccagggcggggcggggtgggcggaggggagggacagggggcggagctggagggggtggttcggtgtgggggccgttggctccagacaaataaacatggagtccatcttccacgagaaagtgagtgtccgcgtgcggtggggagctgtctgccgcgcggtggcgggcgtggagcgcggcatcacagcctcccggagggctgggtggggtccgagtcgcccccatgccgatctcgccgggctaggggcgacgccgcaaccccccgcctcttcggctcggggaggggagcatcacctacgctcctacttcccccgcggcccccgccctgggagccgggagggagtatgggcggggccgggggcgtctcgggacacgggagcgcggtggcgcccagtggatttgcttcttcctttctaagtcactttccatagcttttcggaggattccttcacccctccccaatctttccctctccctagggtctagctacagtcacctctgggacacctccctcgacccctcctaccctactcctggcagaattaacttttctttctccagactgctcaattctatattggagtcttccctacatttagatctttgaggtcttgttcatgttttttcccctgcaccaggtccgcgagcctcccgagggaggagaccttggctcgcccactgtagggcctgacacttaggaagtgaagtaggaaacccgttgtgcccctaaacagggaagtcgtcacgagtttttattacgggatgtttgggtttggtttcttttggtactctcatctttccggagcaggcagccagctttgtttttaggtattaggagtggactggaatgattttgttgtggtctgcctagcctgctgtcactttaactcttcagtgaccatgcacttgaagatactgtttgtgacatgtggagaaactcctcgtttctcacatgctattatccatccatttgtatgtgagtgaagccttccccaggacaactttggcacatgatatcttgtttcataatagtatcatgtttggaaagagttgctggtaaggctattatttaataggaggagcaaagggtttttgttttattaaatgcttataaatgatcgtttatcccagacatttaaaattcacacacacagccgggcgcggtggctcacgcctgtaatcccagcactttgggaggccgaggcgggcggatcacaaggtcaggagatcgagaccatggtgaaaccccgtctctactaaaaaaaatacaaaaaatgagccgggcgcggtggcgggcgcctgtagttccagctactcgggaggctgaggcaggagaatggcgtgaacccgggaggcggagcttgcagtgagccaggatagcgccactgcactccagcttgggcgacagagcgagactccgtctcaaaaaaaataaaataaaataaaataaaataaaattcacacacacacaacaaataaagcaaagacaaaagaatacatttaccagatgtaaatctgtagtataaatcttttttttaatttttattttaaagatggcatctcattctgtcacccaggcaggtgtgcagtggagagatcatggctcactgcagccttgactccctaggcacaagcgatcctccctcctccgcctccagagtagctgggactacaggtgtatatcgccagggccagctaatgtttttggagagacaggggtctcgctgtgttgcccaggctggtctagaactcctggactcaggtgattctcccacctcagcctctcgaagtgctgtgattacaggcgtgagccactgtgcctggaacaaattgttaagtacaatgcttttcattgtagaaaacatctcggaaacttttgaaataggcagatttacagtgggggaggaaggcctcagtcgtatagttgtcactgattttttgacttgattgacatgatttataaatcatagacaatagagatttagttgcttggctgagtaaagtgtgtgaaaaatacacatgtactttcttaaaaacattttttttttgagatcgagttttgctcttgtcacccaggctagagtgcaatggcgcgatcctggctcactgcaacctctgcctccctgttcaagctattctcctgcctcagtctccctagtagctgagattacaggtgcccaccaccacgcccagctaatttttgtatttttagtagagacagggtttcaccctgttggccaggctggtctccaactcctgacctcaggcgatccactcgcctcggcctcccaaagtgccgggattacaggcgtgagccactgcacccggccatatttttgttattaattttcaaaggctttggtgtgggaccagatttcaacatggaaggccttaaacatgttccacactacttcctgagaatcagacaagatttttaacaatattgattgttacctagttgggacgcatttctactgaaccatgggatcaataaaagctgggtgctagccttgcgaaaatctacttacccgaaagaagtccctcttagtccgggtgcggtggctcacaccagcgctttgggaggcccaggtgggtggatcacaaggtcaggagtttgagaccagcctggccaacatggtgaaaccacgtctctactaaaaatacaaaaaattagccaggtgtggtggcaggtgcctgtaatcccaggtactcaggaggctgaggcaggagaatagcttgaacccaagaggcagaggttgcagtgagctgagactgcaccacttcactccagcctgggcaacaaagcgagactctgtctaaaaaaagaaaagaaaagaaaaaaaaaagagtccctctgaattatcagcatgtgtataggcctacagatacttcaggaatgtatttaccattatcattaacttgtatgtacatagcaagtgaagattcaacaatttagttttttgggcatactcaagagtatgcacctataaccatatggcccattgttaatctcctatacagtccattctaggaatgtttgggcttactgtgccatttttcagttcaccgccttcccctctgcaatatacctttaacccttgctaggtgctgggtttggagagccagagaaccaactttggccctagagaagctgggtaggtgggaatatctgcctacaaagggccttgcaaccacttcctcttggaaccttggtttcctctttctgagttgtcactttgagtaccctttattaagttagaatgtaaaaacagtttcgcactgatacatctacagtgcctgagatagggcctggcacagagtaagtactcaataaatatttgaatggggctgagcgtagtgagacctgtctctacaaagaatgaacaaaattagcccgggtgtgttagcacacgcctgtagtcatagctacttgggaggctgaggtgggaggattgcatgagtctgggaggtcgaggctgtagtgagccaaggtcacaccactgcactccagcctgggggacagagcaagatcctgtcccaaaagaaaaaaatgtatatatttgaatggataaagagaggtctttgagtttctgagatatatatggtgctgtttatctaaagtaaacaacttttctgtaaacattttaaggctttgcaggccagctgtagtctctgtcacacattcttatgtgtgcatgtttttcccaaccatctaaaattgtaaagtgcattcttagctaccagggcaggttaaatttggcccatgggctagagtttgccaacccctaacttaaacttttgtactaactttatgaccactaactactggatttttgttgtttgttttagttctggtgcctgctttctgtcttttttttttttaaatcacttctctttctgatgtttcttggtgcagtcactgtgccatttgtattggtgattttaatgtaatgcaaactgggaataataactaaacttgctgggattgtacataaagttattgaaaagatgctgagtattgactctgtggcattcattatgcccttttgtggttgctggattttagctgtctttaggatatttgagctttaggagaagccaaattctgtataaatgacttgaagtgctaatggcacagattttgaaacctctgcctgggtttgagtctcagctctgccttttactacttgtgtgatcctgagcaagttacttaggatccctgtcctctggtttcctcctgtgtagtggtggggataataacatagacataacctcagagttagagtgtagagaaggctccctggcagatagtgctgtagaagtactggccattgccattactcagatgcttgtgtttgctgatcctcatagtaaggcctcggagagcactaagaggaggtgagaatgctgctagattgacagcttgtccccagatagcccattcctgagagcatcttagctttatacctgatttgtgttgtagttagtagtgtctgtggtaattttaactagtttcaggttggtcttgaaaacctggaaaggttgggggtaaatgatttggtagcagttcccttgtgattttataaattatctttgtagaactgcagtgtgctaattctctgagcccaacacaatgaagtctgggcctaaaatcataggatttcttttattttttaaaatttttaattcatttcatgtcttttcttttcttctttttttttttttttttttgaggcggagtcttgctctgtcaccaggctggagtgcagtggcgtgaagtcagctcactgcaacctccgtctcctgggtttaagcgattctcctctcagcctcccgagtagctgggtctataggtgtgtgccaccatacccagctgatttttgtatttttagtagagacaaggtttctccatgttggccaggattgtctcgatctcttgacctcgtgatccacctgccttagcctcccaaagtgctgggattataagcgtgagctaccatgcccggcctattttttatttttttgaggcggagtgtcgctctgtcacccaggctggagtgcagtggtgcaatctcagctcactgcagcctctgcctcctgggttcaggtgattctcctaccttagcctcccgagtacctgggactacaggcgcctgccatcacacatggctaatttttgtatttttagaagagacagggtttcaccatgttggccaggcgggtctagaactcctgatctcaagtgacctacctgcctcggcctcccgaagtgctgggattacgggcatgagccaccattcccagccaaatcatgagatttcaatactgctgaactttgattatggcaaagtgaactactgctttgattaaagcttgatgagagaggtggctggggatagtttgagataagggcaaggcaggaaaatgcataatcttaggtgggctcattgtcattgtacaattcttttggtctgtgtggcatttgatctgtcctatgacttaagttacgtttatttttatttttatttttatttattttatttctttttgagagacatggtgttgctctgtcacccaggccagaatacagtggcacaatcatagctccatgtagccttgaactcctgggctcaagtgatcctcccactcagcctctcaaacagttgagattacggtatgaaccactgtgcctagccttaagtcatttttaaatttgtactgaacagtttgtcctttccttccattaaatcatattagaagtacagaacttgatatttcctgtagcaatacagtgtatctttgatgaagtttgatttcaaatacttatttttcataatttaaagctattttttatagagataattttaatcaaatatttggatgtcgctattgctatatgtgatattaagtatggtgaccatagtttgtaaactccaaactgacagcaggacaggaaatttgtgttagcaaaggcttttttcttactgtttgaattttttaaaaattaggtaccatacagagaggagcacacaaatcgttaagagtacggctcagtgaattctcacaaaatgaacatgtgtaaacagcaagtaacagaagatttacctgcatcctataacctcccattattcccttttctaggtactctctctccactgcactcccaacaaaaataacccctatgctgaattctgatatcataaatgagttttgcctagttttgagcttttgtgactggaatcgtacagtgtgtatacccttttgactctgtcctctttagtttaccattgtttgagagatttatccatactgttccaggtcgttgtagttaattcattcacattgttatgtagtattcctttgtgagtaaacacaatttccattctgctgtgatcccagctatccatttgggtcgtttccagtttagggaccattacaaatagtaatgctatctgtaatgctattttgtgttactacaaatagtaatgctatttgtagcacaaaaatagtgcttttgtgaacattctttttttttttttttttgagacggagtctcgctctgtcacccaggctggagtgcagtggccggatttcagctcactgcaagctccgcctcccgggttcaccccattctcctgcctcagcctccggagtagctgggactacaggcgcccgccacctcgcccggctagttttttgtattttttagtagagacggggtttcaccgtgttagccaggatggtctcgatctcctgacctcgtgatctgcccatctcggcctcccaaaatgctgggattacaggcttgagccaccgcgcccggccctacattcttatacatatcttttgatgaatatatgtttgcatttctgttgtttacattatgtacctactaatggaattgctagatcataggagatgtacatgttaagctttagtagatgcattacataattattagttattattggttataccaatttactctctcaccagtagtatacaacagtttctatatctctgatctccaatattttagccattttagagtttgtgtaataacacattgtggttttaatttacatttccctgatgactaatgaagttgagtaccttttttgtgttctttatagctatttgactgtcttgtgaagtgcttgtttgtcttgccttttcttttctttctcccctcccctcccctcccctctttttgagacaggttcttgccctgtcatccaggctggagtgcagtggtgcaatatcagcttactatagcctcaacctttttggggctcaggttatcctcctatctcagcctcccaagaagctggactacaagcacacaccaccatgctcagttaattttttaatttttgtagaaatggggtttcaccatgttgcccaggctggtctcaaacttctggactcaagtaatcctcctgccttggcctcccaaaatgctgggattacaggcatgagccaccgcagccagccttggctgtttttcaataggttataagtagaacatctgtatatcccttcaatttgcatatcattcagtaagagttgcactctggtagtagaaatatagaagaaagagaaagaagtggaaacaaaaagtctattttcatgagaagacttgggggctagtgttctctctggctccaagctacttattccttaccaaaagatgaggataaacttatctcagactcaggctgtctcaatgctgtcttcctattccattatacacatataacccatatttttttcaccagctgaattttgttcctagaaaattgatttatcaggaaaaaattccgtcttgcaaggtggttctctttagagtctactgtgtaacatagctcaggacaaattgtgtgatgtcagataagttgggttaaggaatagaccttattggggaaagagagaacttggagggccaaggttagcaggagaaggaaatgttctctcatctgctatcatttcaggaaggggcaaacctggtgtctgtgttcacagggagggatccatctatacgtgattctcccttcttaccaggtagcatgggaaagctactgctgtggggaggaggattacacacaggttactcggtaccaggcaccctggacttggattcaggctgccagttgtgtgagaaactgcccagcacttgaaggttctgaacccgtgggaggttgtacctacctcccataaggaggaagcctgtcgtcccgtgggagctgagcttgggtgcagtccctcttgctggcttgtccaggagtgagctccagggttgtttgggacagttctgctcattgcattacgctgcgtgtacattatctgtagagttccatgaagagaacttcagctctgtaactgcaagttttaacatggaacagaatttttctcacctgtattgattcttaagatttgaaattctgtcaacaagcatttaaattgtgtggagtgttttttttttttttttttttttttttttttttgagacagaaggctggagtggcagtggcatagtcttggctcactgcagtctgtacttcccaggttcaagcgatgctcatgccttggagtcccgattagctaggtgtacgggtgcacaccatcacactggctaatttttgtatttttagtagagacggggtttcgccatattggtcaggctcatctcgaactcctggcctcaagcaatccacccgccttgacctcccaaactgctgggattacaggtgtgagccaccatgcttgaccggcattatgttaaaagaataaatgttctaggcagctaggcacagtggcatgtttctgtagtcctagctgctcgggaggctgaggtaagaagatcccttgggccctggagttcaagtccagcctgggcaacatagtcagatctcattttttaaataaataaataactgttctagagactaaaatttcctttcaccattagtaatttactgtggaatctccaagaatgaacttattttaggtagtgaaaatgagggagactaaatgttttatacagtggtttttagtaaagtatgagatttgatgcatttgatagatgataatgtttttttgttttttgttttttgttttttttttgagacagagtcttgctctgttgcccaggctggagtgcagtggtgtgatcttggctcactgcaggctccgcctcctgggttcatgctattctcctgcctcagcctcccgagtagctgggactacaggtgcccgccaccacgcccggctaattttttgtattttttagtagagatggggtttcaccgtgttagccacgatggtcttgatctcctgacctcgtgatctgcctacctcggcctcccagagtgctgggattacaggtgtgggccactgcacccgaccgataatgtttgtttaaaataattcttaaatttttgatcatgtaatgtagtttcattaatagtagatttgtaaaataaatgttaacaaatgaaaatgcatgtacctatgttaattatacttatctaaagctgaaagttcagttcaactatgttaaaaaatagttggagccgggcacggtgactcacacctgtaatccgagcacttggagaggcctaggcgggtggatcacaaggtcaggagatcgagagcatcctggctaacacggtgaaaccccatcactactaaaaatacaaaaaattagccgtacgtggtggcggcgcctgtagtcccagctactcgggacgctgaggcagtagaatggcgtgaacccgggaggcagagcttgcagtaagctgagattgtgccactgcactccagcctgggtgacagagcaagactccgtctcaaaaaaaaaaaaaaaaaaaaagagttgcccaggcgcggtggctcacacctgtaatcccagcactttgggagactgaggcaggcggatcacaagatcaggagttcgagaccatcctggctaacatagtgaaaccctgtatctactaaaaatacaaaaattagccgggcatggtggtgcatgcctgtagtcccagctactcgggaggctgaggcaggagaattgcttgaacccaggaggcagaggttgtggtgagccgagagtgctccactgtactccagcctggacaacagagcaagactgtgtctcaaaaaagaaagaaaagttaatgattaaattatttaggggaaaatactgtgcaattctgtttaataagtcacattttaattttttcttttggaaatattagcaagaaggctcactttgtgctcaacattgcctgaataatttattgcaaggagaatattttagccctgtggaattatcctcaattgcacatcagctggatgaggaggagaggatgagaatggcagaaggaggagttactagtgaagattatcgcacgtttttacaggtactgatgttaaactcactaagtcacattttctttttttttttttttgagacggagtcttgccctgttgtccaggctggagtgcaatggcgcaatctcagctcactgcaacctctgcctcctgggttcaagcaattctcctgcctcagcctcccaagtagctgggattacaggcacacgccactatgcctggctaattttttgtatctttgttagagacggggtttcaccatgttggtcaggttggtctggaactcctgatctcatgatccacctgcctcagcctcccaaagtgctgggattataggtgtgagccaccacacccggcttacatttcttttaaaaacgtagatactatttagaaaaggatgtgccattcttcctatagggatctgactggtgaattataactgcactgttaactttggaaatggaaatgcaaagatgttattttaaatatgcacgctaatgacagtttgtatccttctttccccacccccacgcgtgcttcaactacctgtcaaaattaacagcagccttctggaaatatggatgacagtggttttttctctattcaggtaagtagtcacaagcatctactatgtgttgcttacatcccaggccccgtttcacagcctttcaatagtcactataacaaggcgaccttcagaagttcttctaatagatcatgtctacagagtataagattatactctagatcactagattgtgatccacctgcctcagccttccaaagtgctaggattacaggcatgagccaccatgcccggccaactagagtactagatttttatatagataaacatgaaaggattgtagaatcttcatattagagtggggcatttaaaaattcctttttgagaaagattatttaatttgcatctggatgctaataataaccttaattctggccaggcgtggtggctcacacctgtaatcccagcactttgggagggcgaggtgggcggacctcagggtcaggagatcaagaccatcctggccaacatggtgaaaccctgtctctactaaaaatacaaaaattagctgggcgtggtgatgcaagcctgtaatcccagctactctggagactgaggcaggagaatcgcttgaaccagggagtcagaggttgcagtgagccaagatcgcaccactgcactccagcctggtgacagagcaagactctgtctcaaagaaaaccaaatacccttaattataataagtcccaatgtctcaaacttaccatttgttgggtaaacttaagaaaatgcagtaccttgctaccatccttttaaatcagcctaccagactggatttccttattatggtctgtggcttttgatttttctctttgagttctttggtggttatatatatgtacttgaaagattcttttatctgcgtgtctttcattcttttctgacactgtgagttgtatccagaggtctttcagaacctctcctgagcgacctatctctgcagatacctttgtttgtatttctcttgtactgccctcctggactcctcctcatccaccagcatttccatctagtgctttaccgtgccactgttaacaggtaattgctactgcagggctggaatcagaggtcagagtaggcccagcacttggcgtttcctatttgtgccttgctgctcttggtacccactgccttgcactcactttctgtctttgccggtacctggttgacttgcttctttgttggctaccttggagggtagatagtgaattttcagaaatttcccattttttgtcagacagattgaaataatcaggtttgcattttgtttttttctacaagtggcaagcccatgaccctggaagtctgatacctatggaaacttcagtttaagtgcccagggagaacttattttggtagacacgatttctgacattgcaagtagtaagttgaatatacattttctaaagtagcacccacggcagccaaattaccagatgtatatagtagactagttttaagaatagcacttatgggtagaatatacatacatctggatttttgagacagttttatgtaggaattgtgtggttttctggaacatctcagagacctggtatgaaaagcactcttctaatatatatgtgtatgttttttatggatttagtgatatatctatacacacacacacttttgaaaacctatagccggctgggcgtggtgactcatgcctgtaatcccagtactttgggaggccgaggcgggcacatcacaaggtcaggagtttgagaccagcctggccaacaaggtgaaaccctgtctctactaaaaatacaaaaattagctgggtgtggtggcgcatgcttgtaatcccagctactcgggagcctgaggtaggagaatcacttgaactcaggaggcagaggttgcagtgagccgagatcatgccactgtacttcagcctaggcaacagagcaagactctttgtcttaaaaaaaaaaaaaaaacaaaaaaaaacctgtagccttctagagaaatttatatatgaggtacacaactaacatagctatacttcttaaagtgtttacacaactgacatagctatacttcttcaatttggaatggagtggtttggcttatgaaaagttactatttttcttaacaggttataagcaatgccttgaaagtttggggtttagaactaatcctgttcaacagtccagagtatcagaggctcaggatcgatcctatgtaagattttgttttgcatttcatacatttcttttcccaaatttgatttttaaagatatttcttaaagaagagaaatataattggaatacttgtgttttgatgttccctgtttcattccctcagactttcctatttcacctttgtgatgtccatgagcatctgccctgtagccttcctggcaccccagtgtctgtggcagcacagagctgccccgtaagtggtgcgtgaggccatcttttggcccggcatcactaagctgctgcagagacgttcatatggttgtgtgatcttttaaaaacatcagtgacacttaactgtaaatctaatcttaaattatcacaaattttatataatgtttgccagtagacaacataagtatgaattcaatatttcaagttaatattgtgtgttttcttttttagaaatgaaagatcatttatatgcaattataaggaacactggtttacagttagaaaattaggaaaacaggtaacatttcttacccttccttgtctttttttcttatattgtgccccatttaaaactaaaatgtgggccagatgtggtggctcatgcctgtaatcccaacagtttgagaggcttaggttgggggatcacttgaagccagaactttgaaactagcctgggcaacaaagggaggtcctgtctcttattaaaaaaaaaaaaaaaaaaaaaaaaaaaagccaggtatggtggctcacatctgtaattccagctttcttggaaggctgaggcaggaggatcacttgagctcaggagtgtgaggctgcagtgaactatgattgtgccactgtaccccagcctgggtgacagagtaagactctgttttataaaacataaaaagaaaaagaaattttaaaattaaaaagaaaaaacaaaaggattgctgactttaaaattaggaaactgactagtaatgtgtgtgtttgtggcatggttatctatcttgatagatagaaatttgtcattttaaaacatatcagttttccttgtaaatttatttgtgacaagtatatgcaatttaactatatcataagaaaaattctatattaaatataatacaaatgtggttactttgaagtgggtttttatgtgatgactatgttctgtcagttaattactacatttgtagatttgtatttagcatagtgctgtcacaaagcctgaaatagtgtcaagcatgaataaagcattcaattatgcttgctttagtgtaagattattcatatgattccaaaagccatgtaatacatacgtctacataaaatcacttctatttgttaaataaaacatgaaatatgtcttgagcaagctattttaagaaacagaatcatttaacatcctttttattagaattttgaatctttgaaagagggttcttgaaaaccagctagcacagtaaaaaagaataaactagtgatacatgcagcaacatggatgaatctcaaaataattatgctgaaagaataaccccgaaacagaatactacatgctgtatggtatcatttattaaaagtctagaaaagtgcagattcatctgtagtgatgaaaagcagatccaccagtggttgcctggggatgaaaaggctaaggaagagtgagaggggggagggtcagagagaggcatgggaaacgtggcagtgattaatgtgtcacagtgttggttgtagtaatggtttcatgggagtacagtatacaaatgtcaaaacatttcaaaggccaggtgcagtggctcatgtctgtaatcccggcacttttggatgccacggcaggaggatcacttgagctcaaggagttcaggaccagcctgggcaatgtcacaagaccccatctctacaaaaaaatgaaaaaaaaaaaaaagaaaaattggctaggtgtggtgatacatgcatgtagtcctaggtgctagggaggatgaggagggagcccagaggtcaagcctgcagtgagtcatgatcgcactactacactccagcttgggtgacagaaggagatcctctctcaaaaaaaaaaaaagtttcaaattgtacactttaaatatgtgaagtttattatatatcacttataccccaataaagctgtttgtttttttaaaaaagtaaataaaagccaaaaaagatatgtcaagaaagtatattgaattaaatctataagagataattcaaaaacaaaaaccctattgttatcttttaagtcacccaaatcaaatttgggaaaagtcacctacttagcttcatcctaagttggttcgttctttctttctttctctctttctctctttctgatggattcttgctctgtcacccaggctggagtgcagtggtgggatctcggctcattgcaacctccgccacccaggttcaagcaattttcctgtctcagcctcccgagtagctgggactacaggtgtgcaccaccacacccagctaatttttgtatttttagcagagacggggtttctccatgttggtcaggctggtcttgaactcctgacctcaggtgatcctgtccatctctgcctctcaaatacagggaatacaggcgtgagccaccatgcccagccctaagttggttctttcttaaagttcttcctgaggagccaagagcaagttaaggaggtgtaatctagaagcttacagtggaggctagctgggtgcagtggttcacgcttgtaatcccagcactttgggaggctgaagcagggagatcactgaggccaggagcttgagaccggcttggaccaacacagtgaaaccttgtctctaccgaaaaaaaatttaaaaagtgcaacttagagcagtagaggctgacacgagtgggaatcacctctaggtaaaaaccagggtagggtactgctgagattatttaacctctgggttttatttacgtgtttttaaaaattatgatccagtattctttactttttttgtataaagtaagcactgaatttttaaggtctgtagacttagatttcagaagtaccctcgtattaatttgcaaataaatgtctatcttattattttgagagatttaaaaatttttagttcttcaaaattgaattttcacattttgaattacattatctttgacaaatacagatgatgttggccgggcgctgtggctcatgcctataatcccagcactttgggaggctgaggtgggtggatcacctgaggtcaggagttcaagatcagctttgccaacgtggtgaaaccccgtctctactaaaaatacaaaattagctgggtgtgttcgcgcatgcctgtaatcacagctacttggaaggctgaggcaggagaattgcttgaacctgggaggtggaggttttagtgagccaagatcacgccattacactccagcctgagcaataagagtgaaactctatctttaaaaaaaaaaaaaacaaaaaaaaaacaaatacagaagatgtcaaattttggtttattttattttctttggttctaatttatatttttgtttaaaactatatttttcactatagactctgtctgaggtccctgtataataaaaaagaaggctggaaaaagtattaacattgtcaaaatccaggaaaatagttggtcatgatactgacagtaactttaaacactttttgtatcttgtgggttaaattaggattactttgtggtagtgataaatgatgttaattagggccgagtgcagtggttaacacctgtaattccagcatgtagggagactgaggtgggaggatgtcttgaggccaggagtttgagaccagcctgtacaacacagagacccccatttctacaaaaaaaattagaaaattcgtcaagcatcttggtgcacacctgtagtcccagctatttgggaggatgaagcgagagaatcacttaagccaggggttcaaggctgcagtgagttatgattgcaccactgcactccagcctagatgaccatctctttaaaaaaaaatgtgtttatatgttatatgtgatagtgttttttaaaaacatttttaaattatagagggtctcactatgttgcccaggctggtctcaaattcctgggctcaagcaatcctcccacgttagcttcccaaagtgcttggattataggcatgagctgccatgcccacctaatttagtgatttttaaaaactgagttggtaattataaattatcttcctggaacttctgactttctcacaattggaatcttttgacaaaaattatcggtaatgggaaaactttgtatagttgtcatttttcctcccatcagtatgatagatgcgattagagttatgttggactgatactttgaaaaaagatttaactatagctattaataaagacatttcaactacggactatccatttttattcttttgggagggtttaatgtttatagtttaaagcaaagtgttgtttttaaaaaactatttaacagggccgggcgccatggctcacgcctgtaatcccagcactctgggaggccaaggcgggtggatcacaaggtcaggagatcaagaccatcctggctaacactgtgaaaccccatctctactaaaaatacaaaaaattagccgggtgtggcggtgtgcgcatatcgtcctagctactcgggaggctgaggcaggaggatggcatgagcctgggaggcggagcttgcagtgagccgagattgcaccactgtactccagcctgggcaacagagcgagactctgtctcaaaaaaaaaaaaaaaaagagtatctaacagaggccgggtgcagtggctcatgtttgtaatcccagaactttgggaggccaaggcgggaggatcatttgaggtcaggagtttgagaccagcctggtcaatgtggcaaatgtgctgtctctaactaaaaatacaaaaattagctgggtgtggtggcgcgggcctatagttccagcttcttgggaggctgaagcaggagaattgcttgaacctgagagacggaggttgcaatgatctgaggtcatgccactgcactccagcctgggtgatagaatgagactcttctcaaaaaaaaaaaaaaaaaaagtaatagtgataaatctgcagtattctcttttaagatattattcagtcagaggaaagagctcaacttgaaatatttccagagtttaaacaatcttactaaactttgatgggttatatctgttcttaacatgtgaaactactttattacctataatatgcactaacttaaatattgacaattttttttccagtggtttaacttgaattctctcttgacgggtccagagttaatatcagatacatatcttgcacttttcttggctcaattacaacaggaaggtaagtaaaggctgaaaattttgtaacgttatctttcgaagtagttaaataaactggagcattagatgacagtgtgacaatactgtttttctggcagtggcagtgaaacaatctttaggtttgacgtggtgataggctgtgatttgggtgacgctgttccattagagttctcactggcacctggccctccctcttctgaggatgctgctttctttgcagcccttctaagtaatggttttttcttttatacatcacataccacacagctgagaggagggatagatatttttcttttttgcctcttctaggccactgttcttccctataaactccagtttctttgaaatacatgcccctaagggccagttgtggtggctttcgcctgtaatcccagcactttgggaggccgaggcgggcagatcacgaggtcaggagatcaagaccatcctggctaacggggaaaccccgtgtctactaaaaataacaaaaaattagccagttgtggtggtggacacctgtagtctcagctatttgggagactgaggcaggagaatagtgtgaacccgggaggtggatcttgcagtgagctgagattgcgccactgccctccagcctgggcgacagagactccatctcaaagacgaaagaaatacgcgcccctagattaaactatcccttgcccttttgcactcatccaaaagtctcttttcatcagtgattttaggatctgactcattgtgtttttctctacttcaactccttttatcattcttaatgatttctgtattgctaatcaatccagtaatccagtacctacttcttagtttcaaaatcactcactcttgcttagctattaccaataatcataaccactgtcaaatctcaattgcaagcgtattactctttaactaccacctcctatccttaaaccatgttttatctgttttttttattccagccattctttaaaccctaccgtggggcccaagcatttcctttatatgcattcttcctttcttctgctgcttattttctgtaattcattgttataatcactccattgcattcttcagcttgtttcccccttctctccctccatcatacttgaatgacaaaaatctcaaccctggttaaaaccaaatcttggccttgtccattcctgtaccagagtagcaggatatggctaaaaaataacataaaacatgatgattggttttacttttttcttaaacgatctatccatccattcacccatccatctgtctatcaaagtgactaggcctctctgaagcccaggctggagtgcagtgacatgatcacagctcattgtagccccacactcctggcctcaagtgatcctcttgcctcagccttttgagtagctgggactacaggcttgtgctaccgcacctagctaaggttttactttaaatttattataatcacaaaattcagatgagcctttagtgctgcctgatatttctactatgttttcttagtaaatccccataccactctccaagatgtttataaaaaatcatgtaccactctccagacgtttataaaaaatcatgtgccactcttcagatgtttataaaaaatcatgtgccactttccaaggtgactaatttcacagcttctgtcttcaaacctttaaccactttcctctcccttccttacacaccttgcgtatggccttccattacattctgctgagaacatagaagcaattaaaattatgttcttacctttctaccagcaagtgtactaatttgcttatatcttcacctgtgctttgcgactactaaaatagatgaatggtcccctacctctagcgaagaccagtccctcacttgtgggctggatcccagctcctctcacctactcaagatgttcctgctttcatctctccactctcttgtataatcagttccccccccgccctttttttttttggtaatgtacctataagcagaaaaataagctttttaactccagtaattaaaaagaaaaatcttctcttaattccatgaaactccagctgcctccccatttttattttttccttaggattgtctctagtgtgccttctccttttcttgaactccgcctcctgggttcaagcgattcttctgcctcagcctcccgagtagctgggattacaggtgcgtgccaccacgactggataattttttctttttttttgagatggagtttcccttttgttgcccaggctggagtgcaatggcgtgatctcggctcactgcaacttctgcctcccgggtttaagcgattctcttgcctcagcctcccgagtagctgggtttacaggcatgagccaccacgcctggctaattttgtatttttagtagagatggaaggggtttctccgtgttggttaggctggtctcgaactcctaactgcaggtgatctgccacctcagcctcccaaagtgctgggattacaggcatgagccactgcgcctggcccctggctaagtgtttttttatttttatatttttagtagagacagggtttcaccatattggccaggttggtctcgaattccggcctcaggtgatctacctgcctcggcctcctaaagtgctgggattacaggcatgagccactgtgcctaaccatcttttagtaatggtatttagagatcacaatttgagtgctggcatgcttattgctactgggtttgttatgtagttattgtgaattcacatttaggaatatagagtttttaattctttgattttagatacttgtatcttttttcttttatagttaaaaccttggttcctaatgatatcccttcttaaaaaccctgtctgcccttgacctccagcccaccatgctgtggttttcctaacttgttgcctgcatctttcagatccctttcatggatcttaggtatatctctaaataagatctgtgtgtcagtaattaccaaacttttatctttagtcttgacatctaccctgaacacctagctttgactaactcctagctttggcatctccactttgaagtccaaaaagcatttcaaactgaacatgtctatgaaagacttattttttttttctatccatgctatctatcaggttttccatttccataagggtgacacttcttgtactctggttcctatatattatactgatagagccgctcagagtgcttcttaaccagtgtaatgcctgttatgtcccaccctcactccttgtctttcagtggcttcccagcacacttagaataaaatctgaagtcttaggctgagcgtggtggctcatgcctgtaatcccagcactttgggaggatgaggggcagatcacttgaggtcaggagtttgagaccagcctagccaacatggtgaaaccctgtctctaccaaaaaaaatacaaaaattaactgggtgtgatgttgtgcacctgtagtcccagctacttgggaggttgagataggagaatcacttgaacccaggaggcagaggttacagtgagccaagatcataccactgcactccagcctgggtgacagaacaagactctcaaaaaaaaaaaaaattgaaaagtaaaataaaatctgaagtcttgaataaaacccaagatcttgaccatgacccctgaacagggcagagtatccattcttcagacactcttcatagaataccatggtgagctggcatatttattgtacgatatagaaacagttttactggcagaaaacacattaaaccatttgaactctgaatacagttgtcctcataaaaaatgttcattgtactattttgaggttttccattagtagttcttacaatctttgtcccattatgtgttaattctaacaaaggatatccaataacaaacaccagagtttaagaaaaatgtgccaggtgcggtggctcacacctgtaatcccagcactttgggaggctgaggtgggcagatcacctgaggtcaggagtttgagaccagcctggccaacatggtgaaaccccatctctcctaaaaatacaaacattaaccaggcgtggtggcgggtgcctgtaatcccagctactcaggaggctgaggcaggagaatcgcttgaacctcctgggaggcagaggttgcaatgagctgagattgcaccactgcacttcagcctgggtgacagagtgagactccatctcaaataaaaaataataataataattaataatagaaaaacttagattgttttaggtatagcccactcttagtttttgtgtgtagcatctagcttggggaaaccctggatttctggaatcatatttatacacagtcacactagactaatgtaattcttttgggatgcaaaccacacgtttgacaccttaaatagcttttaggtatttggcttctcagctcctatttttagttacaaggggtgtacatgtgtgggtcagggtagctctttccacagatgattagttttagccatgttactagttattgcacacattatctgactgtgtcctcaaaacagccctgtgagtgtattagtcagggttctctagagggacagaactaataagatagatgtatatatgaagggtaatgtactaaggaatattgactcatatgatcacaaggtgaagtcccacaataggctgtctgcaagctgaggaaccaggaagcctgtccaagtcccaaaacctcaaaagtagggaagctgacagtgcagccttcagtctatggccaaaggcccaagagcccctggcaaaccactggtgtaaattcaagagtccaaaagatgaagaacttggagtctgatatttgagggcaggaagcatccagcatgggagaaaggtgaaggctcagcaagtctggtccttccacactcttatttctgcctgatttattctagccgagctggcagctgattagatggtgaccacccagattgagggtgggtctgcctctcccagttcactggcttaaatgttaatctcctttggaaacaccctcacagacacacccagaaacaataatttgtagccttcaatccaatcaagttgataatattaaccatcacaggaaggtaccagtatcattatgtttaacagtagaaaccaagacaaatgcagctaggaagtgggagaactgggatcagatgcaggcagtctgattctcaatcagttgctcttaccgactcctttactctctctcataccagtaagtgagtagcctgctcagtcaagtgctatattagtagggccctttacagacatttacttcgcacagtcactcagtgagacggctattccagtcttacaatggagaaagtgaggctcagagattttaagtaacttatcctagatgactttactagtaagtataagaatcattatttgaactaaaatctttctgaatcctcagcttgtatttttttccagtgtactgtgctgcctctttactagcattttacatcaattttgaatctctttactagctgtttaggttgatttttgcctttttgttttaggttattctatatttgttgttaagggtgacctgccagattgcgaagctgaccaactcctgcagatgatcagggtccaacagatgcaccgaccaaaacttattggagaagaattagcacaactgaaagagcaaaggtaaaaatgaggcctgcagtatggaacatatgacgatatttcattatgagaataaaattttcatgcttacattgaatatgtggtccttgtgttgtcggcacctctattttggaccttacattttagtgaagtttattagttcgaacgtgaatcaactctttgaaatacttaaatatattaactaagttagcaggtatggtgtattcctagcacttcaggaggctgaggcaggctgattgcttcaacccaggagtttgagaccagcctgggcaacatggcaaaacctcacctctacaaatagtacaaaaattagccagacgtggtggtgcgtgtctgtagtcctagctacttgggaggcagaggaggaaggatcacccaaaactggggaggtcgagactacagtgagccacaatcacaccaccgcactccagcctgggcaagagagtcagaccctgtctcaaaaaaagaaacagagaaaaaaaacttagttggattcaaattacaacacaatcattatattactagagcttatttgccagaaaacgttttaagttttggcttacgtaaagcctttacattacaaatgcctttatgttatgtctaaaatagaagattggttgcagttactaccagtgcttttgttctttagagtccataaaacagacctggaacgagtgttagaagcaaatgatggctcaggaatgttagatgaagatgaggaggatttgcagagggctctggcactaagtcgccaagaaattgacatggaagatgaggaagcagatctccgcagggctattcagctaagtatgcaaggtaaagacattctgatgtgtgttgtattcattgctgaagaattgattccaattattcttaggtttcctggaagttaatgtactcttagaagtgttttgacaattactgcagaagcaatagctatatagtgggctttccctttagatttcttataatggaaataactttttacaacctatattttattaggagtagttatatttttactcctggttatttatttggtttcaataacctgtactaacacagtagtcaattgtggtgttaatctttgtgggtatcagttgacccttacccaaatcagctctttcataaatgtatgtcattagacactatggaagggcctggacaggggatataaactgattatacaaaaagccaacatttattggctatgcaacttaaaccttaagcccgctttggtgggcccagttttttagtgatataaactatcaatttcaaaagtgaaaacatatcccctatacagtctaggcaaagaaaaatgttaagacatagctcgaagttgcttaattaaaagtttgaagtgggttttttgttttatttttctctaacttatgtgtatttgcttctactttctaatgaaattatttatcaattgatttccttagatatccagataaaattgagattccattaatgggaagattattttcatcctgaacttttcttgcctctaggcacacctctgagtactccatatggtgtgcaatcccatttttgattaatagagtcctgctggattagcagggacagaaatcagctttagatttcttttgttttttgaattaagagtctcactgtcgcccagcctggagtgcaacaatcttggctcactgcaacctctgccttccgggttcaagcgattctcctgcctcagcctcttgagtaactgggactacaggcacctaccaccatgcctggctaattttttgtacttttagtagagatatggttttgccctgttggccaggctggtcttgaactcctcacctcaggtgatccacctgccttggcctcccacagtgctgggattacatgtgtgagccaccacgcccagccagaagagtagaatattcttcaagaaaaaacattttaaaagcttactcaaatgaggataaacaaatgtattgttgcttgaattggtaaatacagtgattggtttttgttctgttgtgttttgttttcaggtagttccagaaatatatctcaagatattccacagacatcaggtacaaatcttacttcagaagagcttcggaagagacgagaagcctactttgaaaagtaaagtagttggtacaaattaaagtagcacgtttaatatttgctttggctattttgtctgtttgtaaatggttactgcctgaatcctatgaatatttgaatgcatatttaaaaaatttacagcaaataggacaggcacggtggcttacgcctgtgatcctagcactttgggaggccaaggtgggcagattgcctgaggtcaggagttcgagaccagcccaggcaacacagtaaaactccatctctactaaaaaatacaaaaaaattagccgggcgtggcagtgtgcgctgtagtcccagctgcttgggaggctcagccaggagaattgcttgaacccagcaggtggaggttgcagtgagccgagatcgcaccactgcactccagactggttgatacagtgagactgtctccaaaaatatatgtgtgtatatataaataaaaataaaaatttacagcaaataacatgaagcaaaatgtagttttaatgaaaaagtttgcctcaatactggataaatttttgaaactgagtgaaggaaaccttgtacaatttcatttattaaaagaaaaatgaaattaggacaaggcaagaagaatacctattgatcctttggatgtgcttcttgcttacctgattaaccctgcaaaatttctctaccaatcagtaagaaaaacagcttttgaggtatgggagcacattcccaaatagacatgggtagttcatttagctgctcatggctgctgcagggggtcctgtaggcctgttagcatcaggagaatggatgcaaaccataaatctggatcaactcctaaaactttaccttgtgcccagccttgtaagtgcttgctaaataggaattccactgtatgaaaatacattcttttcaagtaactatcattcagacttttgtcccccacttttttaaaaaaagaaaaagaaaaggctgggtgcagtggcttacgcctgtaatcccaccattgtatgaaataggaattccactgtatgaaaatacattcttttcaagtaactatcattcagacttttgtcccccacttttttaaaaaaagaaaaataaaaggctgggcacagtggcttatgcctgtaatcccaccattttgggaggccaaggcgggtctttgggagtgagtttttgggaggcaggagaatcgcttgaacccgggaggcggaggttgtggtgagctgagatcgcgccattgctctccagcctgggcaacaagagtgaaactccgtcttaaaaaaaacaaaacaaaacaaaaattagctgggcgtggtggtgggtgtctataatcccagctactcgggaggctgaggcaggagaatcgcttgaatccgggacgcagaagttgcagtgagctgagattgtgccactgcactccagcctggggacaagagcgagacctcgtctcaaaaaaaaaaaaagaaaaactccatgttaaaaattacaagataaataatcagacccgctgatcctaggtcagaaaacaaaagactcatagctgaatctgacctgccattgctgtatttcatccattctaagatgcacatagtttcacatttcaatgtctctgaaattgagaagtatcttacaatcataattgacagtatattagcagcacctaaaaatattggctcattttacatttgatggtataatgaagaaaatatttacctttttttctgttttgtttttaagtcacaactcagaagtagatgaaggaaaattctgatcagctgacatcctcttaatgtgagatatttctagtctttattcagcatagattaatggctaattatatgttacatttcaaagtagtgcttattagtgctttttacttttaagtttcaaaattaacttttttattaaactccaaatttatacaaaagtagaaaaactagcataatgaactcttgtttatcacccagattcaacaaatactagcacacggccaatcctgcttttttttttttttttttttttgaggtggagtcttgctctgttgcccaggctggagtgcattggcacaatttctgctcactgcaacctctgcctcctgggttcaggcaattctcccacttcagcctcccatgtagctgggattacaggtgcacaccaccatgcccagctaattcttatatttttagtagacacagggtttcaccatgttgcccaggctggtcttaaactcctgacctcaagtgatccacctgcctcggtctcccaaagtgctgggattacaggcatgagccactgcacctggcccagtctcgttttataatactcccatctcccattctttccactgtcccacctacaagtttggattattttgtaacaaatctcaatcatcatatcatttgttctataaccattttaatatatgtctctaaaatatatgaactttttttaacatagttaaatgctattgtcataaaataatcatgataattaattgtaattctatatcaccaattatctagttaatgtaaaaaataacttaaatctaaggccaggtgcggtggctcacacctgtaatcccagcactttgggaggcggaggcgggcgaatcacctgaggtcaggagttcaagaccagcctgaccaacatggagaaaccccatctctactaaaaacacaaaaaaatagctgggcgtggtggcgcatgcctgtaattccagctagttgggaggctgaggcaggagaatcagggagacagaggttgtggtgagctgagatcttgccactgcactctagccttggcaaaaagagtgaaactctgtctcaaataaataaataaataataaaaaaataacttaaatctacttaattagaaaaactaatattctggaaattttattttaagaaatatctaaattggccgggcacgatggctcacacctctaatcccagcactttgggaggctgaggcgagcagatcacctgaggtcagaagggtcaggagttcaagaccagcctggccaatgtggcgaaacaccgtcgccactaaaaatacaaaaattagctgggcatgatggcgagcccctgtaatcccagctactcaggaggctgaaacaggagaatctcttgaacccaggaggtggaggttgcagtgagctgagatcaccccactgcactccagcctggatgacagagtgaaactctatctcaaaaaaacaaacaaaaaaaagaaatagcaaaattaaaagaaagcatacatggccaggtgtagtggctcatgtctgtaatcccagcacttttggaggctgaggcaagcagatcatttgaggccacgagttcaataccagcctggccaacatggcgaaagcccgtctctcctaaaaatacaaaaaaattagtcgggcatggcggcgcacacctgtaattgcagctactttggaggctgaggcaggagaattgtttgaacccagaggtggaggttacagtgagctgagattgtgccactgcactctatcctgggtgacagagcgagactctgtctcaaaaagtaaaaaaggggccgggtgcggtagctcactcctgcaatcccagcactttgggaggccaaggcaggcagatcacaaggtcaggagatggagaccatcctggctaacacagtgaaaccccgtctctctactaaaaaatacaaaaaaaattagctgggtgtgatggcaggcgcctgtagtcccagctacttgggaggctgaggcaggagaatggcgtgaacccaggaggcggagcttgcattgagcagagatggcgctactgcgctccagcctgggcgacagagcgaggctctgtctcaaaaaaaaaaaaaaaaccgtcacctcctttagtaactgatgttagtattttggcacattctctttctgtgacttatacacacttaccttgtaagtgttgtactcatttcctatgacagtaaatagtctttgtaacaggctgcatgatatttcataaaatgaatggatgtggcataatttatatatgtgccttttgaattatgctattataattaatactgcaatgaacaattcttatattgcctctatgcctcaaatgtctcatcatttcttcttttttctgaggatgtcagattactgggttaaagggtatgaatatttttaagaccttggtacagatttctaaattgctttccagaataattcccatgtgatactttcatcatgtttatttcagactttctttttccttttttgagacgaaatctcactctgtcacccaggctggcgtgtagtggcacaatctcagctcactgcaacctccgccctctgagtttaagcgattcttctccttcagcctcccaagtagctgggatcacagacaagtgccaccatgcccggctaattttcgtgttttttgtagagatggggtttcaccatgttacccaggctggtttcgaactcctgagctcaggcaatctgcccacctcggcctcccaaagttctgggattacaggcgtgtgccaccacacccggccatcagacttttttttatgccattttttgccatataatggtctaaagacatacatcatatagaaactataatacaaaatttataggtatatctaagaaaatgaaagtatatttaaagcataaaaataaacccctcttttacttaaaatttttaaaaaattggattaaaaatatgaaacttccaacaaattgaacttttttttttttcttttttgagacagggtcttgcttttgtcacccagactggagtgcagtggcgtgatcttggctcactgcaacctccacctccctggttcaagcaattcccctgcctcagcctcccaagtagctgggattacaggcgcatgtcaccacgcccagctaattttttttgtatttttagtagagacagggtttcaccatgttggccagactgggctcgaactcctgacctcaggcaatttgcctgcctgggcctcccagcgcgctgggattacaggcatgagccactgcacccagcctgaacgttttatagtagtaaagataattcagtaatgcccaataatgactaagtaagttataacaagaacaatgtcagcaataactagtgctttttagtaaacagggtcaggcaaccttgtaccctttaaaaatgttcaaatcttgatataactccttcctaattggagcaggattgattgaggaggaaagtgtgcagtgatggttaccagcttcagcctcttggcttgactttgcaaatactgtggagaatttggaaagagcttgagaatatcttacatagtcacatgttgctgagaagagttaagaactaacttcttgatgttcatttttaatagtggtttgcattcaaaaccttatagagctcattagtaggagagctgagaagctaatatttgcttttcactaaaattcctgattacttagcctaggtagttccttgtctctctaggttctgtctttgggagcttggctctaaggttatcaagctaactctttcttacctcttacccttcccaaattgaccctggttctgatttgttattcgtatgattttctagtttttcttttccctttttgagtatttgaagcttcatactgaatatagtaatcatagtattcatgcataaagaaaatcataaagtaattgcataaatccataaagtaatcatagttttcatgcattaaaaaaactagtttaggccgggcgctgtggctcacacttgtaatcccagcacttttggaggccgagacaggcgaataatctgaggtcaggagttcgagaccagcctggccaatatggcaaaacctcttctctactaaaaatacaaaaaattagccgtgtggtggtgggcactgtaatcccagctattcagcaggctgaggcaggagaatcacttgaacctgggaggcagaggttgcagtgagctgaggtaatgccgttgcactacagcctaggcgacaagagtgagactcttatctcaaaacaacaacaacaacaaaaactagtttctctctagtgtaaaaaatactgttaagccgggagtggtggctcacgcctgtaatcccagcactttgggaaggcgaggcgggcagatcacaaggtcaggagatcgagaccattctggctaacacagtgaaaccccgtctctattaaaaatacaaaaaattagccaggcgtggtgacaggcgcctgtagtcccagctactcaggagactgaagtaggagaatggcgtgaacccaggaggcagagcttgcagtgagccgagattgtgccactgcactccagcctgggctacagagcgagactccatctcaaaatatatatatatatagactgttaaaaagtctccctattacagattcataatttatgagtcattaaataatatttttaagccatgacattttttccagcaggagtctctaaatctgttttaccactgtaaaaccccaagcaaaactctactacatcagctgtgtcactgtaaaacctgccttaactcacatcagtatgaaattaagcaatgtgtgtgaaactattttataaactgtaaaggattccatacatgcatgttggcaattattaatgtcttctctaggtgtggctttgaaacagatgcagattctttctgctacaaaaaacatagttacaaatgttttgtaacaaggagagacacaaatatcttcatggacatggattgctatgagtttttgattgactaatacttgagccaccacttcagtgatggtataatttatcaaacagtattgagaaacagaaactactggggatgttttaaggagaaaaagtacttaatagagaaattagggttttacataatcttaagaaaagatgaaggtgcagatcttagccaggcctccagagtaccacaaaccaacttgcaggaagagctgtaaccactgccccaattggcacaatgggtaatgaggatattaaatttaagaacacactgctatagcaatgatcctgggcttagaaagctgccaccacaattgcctagacatgggaagtctggcccccactgcaaaagcagtgaagcagaattttgggactggcatctccatgactttgcttgccaccagagaacaaccaaagtagggagatggctggccttatttctgcctatttattttattttattttttgagacagactcttgtctgtcacccaggctggagtgcagttgtgtgatcttggctcactgcaacctccacctcccagcttcaaacaattctcctgcctcagccttctgagtagctgagattataggcacccgccactgtacccagctaattttcttatttttagtagaggtgggtttttgccatgttgaccaggctggtctcgaactcctgacttcaggtgatgcacctgcctcagcttcccaaagtgttgggattataggcgtgagccaccatgcctggcccatttgtgcctttttttttttttttttttttttttgagatggagtcttactctgttgcccagaccagagtgcaatggtggcatcttggctcattgcaacctctgacttccagtttcaagcaattctcctgcttcagcctcccgagtagctgggactacagctgtgcagcaccatgcctgcctaacttttgtttctgttttgtttttttgagatagagtcttgctctgtcacccaggctggagtgtagtggtatgatctgggcttactacaacctccgcctcccgggttcaagcaattctcctgcctcagcctcctaagtagctgggactacaggcacgcaccaacacacccagctaatttttttgtatttttaacagagatggggtttcaccatgttggccaggctggtctcgaactcctgacctcgtgatctgcccgcctcagccttccaaagtgctgggattacaggcatgagccaccatgcccagacaatttttgtatttttagtagagacagttttgccatgttggccaggctggtcttgaactcctgacctcgggtgatccacctgccttggcctccggaagtgctaggattacaggcgcaagccaccgtgctcaacccattttggccttttaaagctcatgtgagcacttaatttgtaaccagaatcctacttgtaaaataatctaagacatgtagcttttagctttgtagcctctataatattaatggcacagtgggagtggatgctgagtgccacttaaacatgttccatctcagtgtcttcacagctggaaggtgtcaacattgtttcaaggtgggcaattgatttacttctcacttttcataaactaaaagtagaataaaggctattcctctaaaattgctatcttacctgtcactcccttgcattctcacctaccttcttgagtggaggggaagagggcatggagtgatagctgatgtgccaggaattctccatactcagtccgtctttcttgtgccatgtcgcagcatcaggatttgctaatgggagggtactgcccttatgtgcatcattagccatgcacactaaagtcttacacctacacacaggtcagtattcgggcttagagaccaacagggaaaaattgcagttctcattggttgaactttattgttcacagttttaaaacacaaaattgagaggaactctagaaaaaatgtgtcattctattaataattgttgctggtagtttaaaaattctggttccttttcaaattcctatataccccccccccctttttttttttaataccttgatcttagccaaaacaccgagaagcaatcttttttttttttttttttttaacctatggcttctcactgagattgtcagctgttggtaagttttggtttttggttttctgtgtttgtatttacatgtatgaaatctagattgagtatcccttatccacaatgcttgagactagaagtgttttagatttggggttttataggatttgtgaatatttgcactatacttgccagttaagcattccaaatccaaaatctcaaatctgaagtgctgcactgagcacctcctttgagtatcatgttgatgctcaaaaagtttctgattttggagcatttcgatttcagattttcggatttgggatgcctgacctgtaatttcagatttacataaaagcagaaatagtacacagagcgccttatatccttcacccagattccccaattgttggcctttctgaaccatttgggaataatacgcagatatgattttccattatgtctcagttgttcagtgtgtattttctgagtacaagaatatattcctacatatttacatcataactatcatgtttaaacattttaaaagtggggatttgaattacattgtttttccttttgaaaaaattacagaggagctgaatgcaatcaatattacttaaaatctgataatgtgtgttaaatagtagttttcatttatcaagtgttcagtaaatgcttactatgttgtaacagcacggttatcagcactgttgaaatagatgaacaagttaacatttgcactctcattagcttacacgccataaagagggaaataaggagaacaccagatggtaagtttatgctgagaattaaaacgaagtgatgaaataatgagaatgtcagatggctacttttggtgggatggtcaggaaaggcatctctggggagattgttaagctcagacctgaatcaaaagaatgagccagccatggaaacattatgttaactcacatggtagtttgagatgctttatctgatcaaaggtacttattttcagtgactttcaacaatattaagggtctataaaccaacactcatttgcataagaatagctaccagtgaatctttttgtatgataggtttgtttgtttgtgtgtttgtttgttttttgagacagagtcttgctctgtcacccaggctggagtgcagtggcgcaatcttggctcactgcaatctctaccttcccagttcaagtgattctcctgcctcagcctcccaaagtagctgggattacaggtgcctgccaccacacctggctaatttttgtatttttagtagagatggggtttcactgtgttggccaggctggtgtcaaactcctgacctcaggccatccacctgcctcggcctcccaaagtgctgggattacaggtgtgagccaccatgcctggccatgataggttattttgtgatgaaaatacctacctcttaatttgtctgataaatttaaattttatgtctaggtttcctaggatcaacacttctatattttaaagtaatctatatcagactaactgctcttgcattcttttaatgtcagtgactactttgatttgtggaacagtgtattttccacatgaatagtttttctcatggtgtatttattcttttaagttttgttttttaaatatacattcacttttgaatgtttcagacagcagcaacagcagaagcagcagcagcagcagcagcagggggacctatcaggacagagttcacatccatgtgaaaggccaaccaccagttcaggagcacttgggagtgatctaggtaaggcctgcttcatcatgttcgctaccttcacacttttatctgacatatgggctccctctgatttttgctttacattattcttcatcccctctttaatcatattaagactcttaagtaaatttttaatctactaaatttccctggattaaggagcagttaccaaaaaaaaaaaaaaaaaaagctagacgtggtggctcacacctgtaatcccagcactttgggaaaccaaggcaggagaggattgctagaacatttaatgactactttaacataataatttaaacttcacagtaatttgtacagtctccaaaaattccttagaaatcatgatttattttttattttttgagacggagtctcgctctgtcacccaggctggagtgcagtggcgcaatctcagctcactgcaagctctgcttcccaggttcacgccattctcctgcctcagcctcccaagtagctgggactacaggtgcctgccacttcaactggctaattttttgtatttttagtagagacagggtttcactgtgttagccatgattgtctcaatctcctgacctcatgatcttggcctcacaaagtgctgggattacaggtgtgagccactgtgcccagccagaaatcatgaatattagtaggtgaaaaataaatacattttaccacccagaaaatgaaaaatacttgagtataatctaaataacaatgggaagtgcagagttactttccaggtctcggtttaaatatgtcttaaagtttggccaattagtagtagaagttgagagaaaaagtaactgtatctgacaaagaaattataagcagaatatataaagaactcttaaaactgaacaataagagagcaactcaataaaaaggtgaagaatttgaaaaggtacttcaccaaataagacatagggatgacaagcccatgaaaagactctcagcatcactagtcacagggagatgcacaataaaaccacaatgagataccacggcacccctgtaggtgtggcttaatgaggaaataaaactgacaataccaagtgttgacaaggatccaggcagctgagactcatacactgttaatgggaatgtaaaagtgtacagctttgggaaacagtttggcatttttttgataaatgtatacttagccatatgatccagccatcctaatcatgtatatataaccaagagaaaagaaaacttaggttcacataaaaacttgtatcaaatgcttatagctggccaggcatggtggcccatgcctattatcccagcactttgggaggccgaagttggtggatcacctgaggtgaagagttcaagaccagcctggccaacatggcaaaaccccgtcttctacttcaaatacaaaaattagccaggcatgatggcgggcacctgtagtcccagctcttcaggaggctgaggcaggagaatcacatgaacccgggaggcggaagtttcagtgagccgagatcgtgccactatactccagcctgggtgacagagcaagactgtctcaaaaaaagagggctggacacagtgacttacgcctgttatccccgcactttgggaggccgaggctggtggatcacctgaggtcaggagttcaagaccagcatggtcttggtcaacatggtgaaaccccatctctgctaaaaatacaaaaattttctgggtgtgatagtgggcacatgtaatcccaggaggctgaggcaggagaatcacttgaacccgggaggcagaggttgcagtgagccaagattgtaccactgcacttcagcctgggcgacaagaccgaaactccatctcaaaaaaaacaaaaaaggattatagcatctttattcataattgcccaaaattataaactgcctaaatgtagaccttcatttagttaacgaatacacaaactgtggtatatccaaacaattgaataataaaagggatgaactggtacttttttctattcctcctcttaagtacagccaaaacacctcaacatttgtataaaacataagctgggccaggcgcggtggctcacacgtgtaatcccagcactttgggaggctgaggtgggcagatcacctgaggtcgggagttcaagaccagcctgaccaatgtgcagaaaccctgtctctactaaaaatacaaaattagttgggcatggtggcgcatgcctgtaatcccagctacttgggaggctgaggcaggagaattgctcgatcccgggaagcagaggtcgcgctgagctgagatcgcaccattgcactctagcctgggcaacaagagcaaaactgcgtctcaaaaagaaaaaaacatgagctgaatctcaaaggcagggagaagacagaccttggaaccagaggagcagcgtggtggggagtggcctggattttctttttgcctcatttatcctgggcttggtgctggagaagctgtgggctcagaccaagagaaaaccccataaaaagcctgctctctttagccaaaagaggcagcctagcaagacaaaaacttttagataataagcacttgactatagtcaaacaccacagaataaactggccccaaaccctgtcagcaaaggccgagtggaagtcaagatatgtaccgcaacctggaagtcataaggtacacttctcccctttcccagccaacatggtgtcagagaaggctgcctggggagctggggttttccttccctccaggaggtgataacactcctttgccacggtgtcagtggtcacagggagcctgaacgtccacctaataatacataggcatctctctggctcctatgggggtaatgtcagagaagaggcctagtagagaatccagactgttgctggcatccagcagtaacaaggacacctccacaatgtccgtggaggccacgtggggatcagtaacaaggcattcctctccctcccagtcagatgtcagtggaagactaggggactagaactcccgtgtgcattcagcagtaatgcccatgaccaccactccgtgttatcacaggccttgaagaagcctgaactttcactcccctctggttgtagtgaggtggcactccctttttcctgctgccagtgctgtgtcagaggaggcttgccaaattggaagatgtaaataagattcacattctcataacgtaataccccaaattttcaagattcaattgaaaatcactaagccgggcacggtggctcacacctataatcccagcactttgggaggccgaggtgggctgaacacttaaggtcaggagttcaagaccagattggccaacatggtgaaaccccatctctactaaaaatacaaaaattagccaggcatggtggcgcatgcctgtaatctcagttactggggaggcggaggcaggagaatcactgaaacctgggagacagaggctgcagtgagccaagattgcgccactgtactccagcctgggcaatagagcaagactccatctaaatttatgtcatggagtcccagaaggagaggagaaagagggtggggctgaaaaaatattggaggaagaagtcatggctgaaaaattcccaaatttggcaaaagtcagaaacctatggattgaaaaagctgaatgaagttcaaatatgataaactcaaagaaattcacagagacatatcatagtcagatttctgaacactgcagacaaaaaatgaagatcttgaaattagcaagaaacgaccttacctacagcaatttgaatgacagcagatttcccatcagagatcataaaggccagaaggaagggatacatacaacaatttttctagtgctgaaagaaaatatctctaggctgggcacggtggttcacacctgtaatcccagcacttttggaggctgaagtgagaggatcacctgaagtcaggagttcgagaccagcctggccaacatggggaaaccctgtctctactaaaaatacaaaatttagctgggtgtggtggcacatgcctgtaatcctagctacttgggaggccgaggcaggggaattgcttgaacctgggaggcgaaggttgcagtgagccaaggttgggccactgcactccagcctgggcagttgagtgagactccgtctcaaaaaaaaaaaaaaaaaaaaaaaaatttagccgggcttgttggtgggcacctgtagtcccagcactcaggaggctgaggcaggagaattgcttgaactcgggaagtggaggttgcagtgagccaagcttgtgccactgtactccagcctgagtgacagagcgagacctcgtctaaaaaaacaaaaacaagaaaacaactctaaacccagagttacacatccagagaaatatccttcaggagtgaagggaaaattaacaatttttcttcagcagacctaccctaaaagaatggctaaaggaatttctctaaaccaaaaagaaatgataaaagaagtaattttggaacatcaggaaggaagaaagaacaataaaaagagtaaaatatgggtaaacagatagactttaccctccttttgaattttctaaattgatggttgaagcaagaattatagcactgatttgtttttcagtatatatactggaaatatttaaggcaattatgttacaaatgaaggagggtcaaagtatataaagggaggtaacctttctatatttcttttgaattgatgcaggcactttggaaagtaatttcactatttgtttaaaaacgtaacataccctgaccatatgacatagcatctatactcctgggcatttgtcccagaaaaacagaaatttatttatttaatttaaaattttttttttcagtattacactccgtaagtgctgtaattagcacttagagaggccaaggcaggcagattgcttgagcccaggagttcaagaccagcctgggcaatgctgcacaatcaaaaaagaaaaacagacatttagaaaactattttaaatgtctttaattgctgaatgcctctttggctaatatttgtaagatccttctcctcctcctcctcctcctcctcctcctcctccctccctccctcctcctccctccctccttcttcttccttcttctggcagagtctcactctgtcacccaggctggagtgcagtggcgtgatctcggcttactgcaacctctgcctcctgagttcaagcgaatctcctgcctcagcctcccaagtagctgggactacaggcgtgtgccaccatgactggctaattttttgtattttcagtagagatggggtttcaccatgttggtcaggcaggtctcgaactcctgacctcgtgatccacccgcctcagtttcccaaagtcctgggattacaggtgtgagccactgcgcccagcctggaagatcattatttagacctacaactgatgcattgttccactgacacaattgcccaggctggtcttgaactcctgggctcaagcagtctgcctgccttggcctccctaagtgctagtattacaggcttgagccactgtgcccagccaaaaatagaaatttatattctcacaaaaacatgtacatgaatgtttatagcagctttacttgtaataatcaaaaactggaaatgaccaaaatgtcctacagtgaaacaaactgtagtacatccatagcatgtaatactctactgtcaggattaaaaagaaaccaactgttggcacaggcagcaccgtggctggatctcaggggcattatgctgagtgcaaaaaagcctcaaagggtcttatactgtatgattccatttgttcaacgttctaaaaatgacagctgtatagagatagagaacatattagtggttgccgctagttagagaaagtgggtgaaggagaggtgggtgtgaatataaattgataggagggagatctttgtggtattataacacttctatgtcttgattgtagtgctcatggttacatgaatacacatgtgtgataaaatgccatgtagaactacatataacattgtgccaatgtcactatctaggttttagtttgatctttagttacgtaagatgtaactgttgggtgaaattgggcaaaagaatacccgaaacctctctgaaatatctttgcaacttcctttgaattgacaattatttcaaaatagaaagttgggtttttgttgtgtatatcaacatgagtatatcaacatgaattgttgatatacacaacatgagtatatcacaacatgagtatatcaacatgaactgctgatattgttgatatacacaacaaattggtgatatacacaacaaatcccaaatgcattacactaagtgaaagaagccatattcaaaaggctacatatctactgatgccttttatatgacatgcaggaaaagatgaaactgttggacagagaatatactgttggctagctgggattaggaattggggattgaccacaaaggggcagcatgagggagttttctggggcaatggaatggttgtatatcttgacagtgtatttgtcaaaatatatagaactataaaagtaagttttgctttatatgcattaaatcaaaaaaagaaactcgtgctcaaatagaaatacattttctgagagcttaccttttgatgactttgagaattttctggaaattttaaagaaatgtggttttgtttcccaacaggtgatgctatgggtgaagaagacatgcttcaggcagctgtgaccatgtctttagaaactgtcagaaatgatttgaaaacagaaggaaaaaaataatacctttaaaaaataattgagatattcatactttccaacattattctgtgtgattacagcatagggtccactttggtaatgtgtcaaagagatgaggaaataagacttttagtggtttgcaaacaaaatgatgggcaagtggaacaatgcgtcagttgtaggactaaataatgatcttccaaatattagccaaagaggcattcagcaattaaagacatataaaatagttttctaaatgtttctttttcttttttgagtgtgcaatatctaacatgtctaaaattaggggcatttttcttggatctttttgcagaccagctaattagctcttgcctcaggctttttccagttttctttttctctcttgtagataatttggctcacatcatctaatagtgactttcatttcttattaaccaaattaacctttcaggaaagtatctctagtctgtgttgataatagtaatggttctagaaggataaacagtcctcccttcaactgtatactgtgtgctccagtgttttcttgtgttattttctctgatcacaacttttctgcgacctggttttcattattttcccacaattcttttgaaagatggtaatcttttctgaggtctagcattttaagtcctgtgatgggatcattatttcatgactggtgcattcctaaactctgaaatcagccctgcgcaagtacttgagaataaatgagcgttttttaaaatgtgtgagcatgtgctttcccagatgctttcccagatgctttatgaatatcttttcacttacatcaaaaccttacagctttgttgcaaccccttcttcctgcgccttattttttccttctccaattgagaaaactaggagaagcatagtatgcaggcaagtctccttctgttagaagactaaacatacgtacccaccatgaatgtataatacatgaaatttggccttcaattttaatagcagttttattttatttttttctcctatgactggagctttctgttctctttacagttgagtcatggaatataggtgtctacttcacatcttttagtaggtatagcttgtcaaagatggtgatctggaacatgaaaataattaatgaaaatgtttaaatttatactgtgatttggcacttgcatcatgtttagatagcttaagaactgtagaagtcatagtacttagtgggtctgtaaataagaaagtccatagttttgataaatattctctttaactgagatgtatagagagtttcttgctgggtcaataggatagtaccattttggtgaaaaccgtgtctctctgaatttgatgttttagtttctgtgttccccatccctcattctccagccccttttgaagctcttttgaatgttgaattgttcataagctaaaatccaagaaatttcagctgacaacttagaaaattaaagtatggtatattgccctactggtgtgtggctgcacacatttcatcagggaaagttttttgatctaggatttattgctaactgaaaagagaagaaaaaatatcttttatttatgattatgaaatagctttttcttggatataacagattttttaagtcattattttgtgccaaagttttctgaagtttcccttacacaaaaggatagttttattttaaaatctaaagttttcttttaataattaaaaatgtttcagaagaattataaaactttaaaactataagagatgttagagtttagtactactccctcaagatttaaaaagctaaatattttaagactgaacatttatgttattacaggtgtgttagtcatattttccatggatatttgttcattacctttttccactgaaaagttacgttaaacttttcatacacttgaattgatgagctacctaatataaaaatgagaaaaccaatatgcattttaaaattttaattttagcgtttataaagttcatatataccctagttaaagcacttaagaaaatacggcatgtttgacttttatttgctagagaggtttttttggttgtttttgtttttgctttttttgagacggagtctcgctctgttgcccaggctggagtgcagtggcgtgatctcggctcattacaacttccacctcctgggttcaagcgattcttctgcctcagcctccagagtagctgggattacaggcgcccaccaccatacccagctgatttttgtatttttggtagagacatggtttcatcatgtttggccaggctggtctcgaactccagacctcaggtggtctgcctgccttggcctcccaaaatgttgggattacaggcatgagccaccgcgcctggccagctggagagtttttaaagcagaggtgagcacacactggatgcgtttgaatgtgtttgtgtagtttgttgtgaaattgttacatttagcaggcagatccagaatcactagtgaactgccatcttggtggggttggcttaaatgtaattgaatgtttagattctatttcttaattgattggccagtatgaaaatatgccagtgcaagtaaccatagtatcacaaaagttaaaagttatgcaaagctatagcttatatatcaggtactgccatttactgtaaaccacctgcaagaaagtcaggaacaactaaattcacaagaactgtcctgctaagaactgtattaaagatttccattctgttttactaattgggaacatcttaatgtttaatatttaaactattggtatcatttttctaatgtataatttgtattactgggatcaagtatgtacagtggtgatgctagtagaagtttaaataagccttggaaataccactttcatattttcagatgtcatggatttaatgagtaatttatgttttaaaaattcagaatagttaatctctgatctaaaaccatcaatatatgttttttacaataatcaacatataaatatttcagtaatataaactgtttgaaaaggctgctgcaggtaaactctatactaagatcttggccaaataatttacaattcacagaatattttgtttaaggaggtgctttgtttttgtccttaaaacttgatttttcttaaggctttattcatgatgccaaagccaatgaggaaaaaaactcaaaaccagttgagtatcattatagacaaaactaccagtagtccatattgtttcatttaatattaagttgaataaattttattccagtcagagcctaaatcacattttgaatgtctgaatttttgatactatttttgaaatcatgctagtgccggccgggcgtggtagctcacacctgtaatcccagcattttgagaggccaaggtgggtggatcacaaggtcaggagttcaagaccagcctggccaagatggtgaaaccccgtctgtagtaaaaactacaaaaattagctgggcgcggtggcaaggtgcctgtaatcccagctacttgggaggctgaggcaggagaatcacttgaacctgggtggcagaggttacagtgagccgagatggtgccattgcgctccagcctgggcgacagagtgagactccatctcaaaaaaaaaaaaaaaatcatgctagtgccaagagctacgaaattcttaaaactcttaaaactggcccattggacttgtacaaatacaaaatagattcaatgcataatcaaaatattttaaaatcttaagtagaaaaataaatcttgatgttttaaatttttaggaggattcgataattaatattgatgacctccaggctgggcacagtggctcacgcctataatcccagcaattcaggaggctgaggcgggcagatcacttcagggcaggagttcaagaccagtctgggcaacatggtgaaacttcgtctctactaaaactacaaaaattagctgggcgtggtggcacacacctgtaatcccagctactcaggagactaagaatcgcttgaacctgggaggcagaggttgcagagagccgagggctcaccactgcattccagcctggcgcaatagagtgagactctgtctccgaaaaaaaaatatatatgtatatgtgtatatatatatgtgtgtgtgtgtgtctctactaaaaatataaaaattagctgggtgtggtggcgggcacctgtaatcccagctacttgggaggctgaggcaggagaattgtttgaacccaggaagcggaggttgccgtgagctgagattgtgccattgcactccagcctgggcaatgagtgaaactcttgtcttaaaggtttttttttttccttgggctactattttctctttctttctttcttttctttcttcctttctttcctttcttttcctttgtttgtttgtttgtttttagtagagacggggtttcaccatgttagtcaggctggtctcaaactcctgacctcaggtgatccgcctgcctcagcctcccaaagtgctgggattacaggtgcaggccaccatgcctggccttgggctactgttttcaaagtgaattgtttgttgtatcgagtccttaacaagtatagacatatgatatatgtgatcctaattaagaaataccagattggatcaactaatcatgtcagcaatgtaaataactttttatttttcatattcaaaataaaaactttcttttattcctggtccctttataaccagcattttttgctttgaaaaatgagctggctttgtagttttttaaagttttaaacataagaaaaatgtcttttgttctatttgctttcatgaatgaagatcattgacatggttggtaaattctagaattttgattttgttttttaatttgaagaaaacctttgctatttttattttttccaaatggtctgacattttaagaatgaatgctaataacttaacttctaaatttatcgtcattggcatgtttaatagcatatcaaaaaacattttaagctggtggatgcatagacaaagcaatgggaaactagtgaaatacacacggatgttcctgaggcacttaggaagctctcagttgtctcttacatagttcaaggaatgttttctgaatttttttaatgcttttttttttttgaaagacaaaaacatacattttaaatgtgattatctaatttttacaacactgggctattaggaataactttttaaaaattactgttctgtataaataaaatatttgaaattcaagtgcagaaaatatctgaaacaaaaagcattgttgtttggccatgatacaagtgcactgtggcagtgccccttgctcaggacccagccctgcagcccctctgtgtgtgctccctcgtaagttcatttgctgttattacacacacaggccttcctgtctggtccttagaaaagacgggcttccaaagcactgttgaacactgaggattctgttgttagtgtggatgttcaatgagttgtattttaaatatcaaagattattaaataaagataatgtctgcttttctatttccttttgaatttgtgtttattgttaattcatagctattcaaagtatgattagagctgagctttgtggcttgcatctgtaattccagctacccaggaggcagaagcaggaggattgcttgagcccaggagtttgagcctgcagtgagctatgatcttgccactgtaattctagcctggtcgacaaagcaggaaaaaagtgtggatggaggaccagcaacatctgtatcacctgtgagtttttcagaaatgcagagtttcaggccacactcagacctactgaatcagaacttgcactttttgcaagatccccaggacactgaagtgtagagtgaagcttgagaagcacggttttatggattgttcttaaccagctgtggtggtgaatatgagtaacgcaggccagcacagtccattgatattctattccagcttactgcctgccaaaaggtccattattactggatcccgagtcttttccaagagaagctaagaattccaaatttttatttgaaatatatttttaaaatggttgctcaattggcagggtgccagtggctcatgcctttaatcccagcactttgagaggccgaggtggaaggatcacttgagcccaggagttcgagaccagcctgggcaacataaagagaccccatgtctattaaaaaaaaaatagagacagaatgctgccttaaaaaaatcataaatgtttgctcaattgatttttaaccctgagggccaaacaaagcacattagtagcaatttttaagagtgctgtttttcctcattgtatctaactctggacaccagaatccaaatgtaatgattggactccacctagactgattgaggaatatattgtcttcacatttagggttgtctattcattttagctttaattaggattgggcacaaattttgaaacataatatgttacaggacagggatcccgatccagaccccaagagggttcttggatcttgtgcaagaatgaattcagggcaagtccataaattgaaagaattgaaagccagttcattaagaaagtagaggaataaaagaatggctaccccataggcagagcagccctgagggctgctggttgcccaccccgcccccccccctttttttttttttgagataatctcgctgtgttgccaggctgtagtgcattggcatgatctcagctcactgcaacctctgcctcctgggttcaagcaattctcctgcctcagcctcctgagtagctgggactacaggtgtgtgccaccatgcccagctaatttttgtatttttagtagagacagggtttcaccatgttggccaggaaggtctccatctctttaccttgtgatgcacctgccttggcctcaaaaagtgctgggatgagcaacctcgcctggctggttatttcttgaggatatgctaaacaaggggtggattattcatgcctcccctttttagaccatttagggtaacttcccagcattgctatggcatttgtcaactatcatggtgcttacgggagtgcagcagtgaggaggaccagaggtcatttcatcgccatcttggctttttcagctggcttctttactgcaacctgttttactagcaagtttttttatgacctgtatcttgtgcagaccttctatttcatcctgtgacttagaatgccttaaccatctgggaatgcagcccagtaggtctcaggctcattttacccagcccttattcaagatggagttgctctggttcaaacgcctctgatatttccctactcccttttataagacaacccttaatcctaagggttgcagagggatgaagatccatcttctgtaacttcttcaggctgaataagggtgatgatattcctgcctatgagagtctcttgtattagggtagaaaggagctcagtcagtatggctctctatccttcctcccttccccagcccctgacaactaccattctactttgtctctgtaattctaagtatctcatataagtggaatcattcagtatttgtagggttttttttgtgactagtgtatttcactttgcatgtcaaggttcatccatgttgtagcatatgtccgaattttcttctttttaaaagctgaataatattccattgaatgatatatgcacattttgcttattcatttatccatcaaagaaaaccaatagcttttttacataccagtaacctggttaaaaaaaataagatggaaaaataccaagcccaaaaatgtcaaattgttgaacaccagagaggtactataattcaagctgagcagaaaggaatggcccttgtctcagccctgagccacatgtcactacatgggccccaagcagctcttcttgtgctcagagtcctgctaagtcttgttctgcactcctctaaagtggctcaaactagcacaggaggccaggagggagcagattctatgccacctccattgcttctgcgccttctccagatccattttttccaaaagctgtgtttgaattctgcacaggggcaggggcatctctgtctccaacactgaaaccccttttaccagacccagagaagactgcctttttttttttttttttttttttttagacggggcctcgttctgtcgcctaagctggagtgcagtggcaccatctcggctcacggcaaactctgcctcctgggctcaagcaattctcctgcctcagccacctgaatagctgggattacaggtgcgggccaccacctccagctaattttgtatttttagaggtggggttttgccatgttacccaggctggtttagaacttctgagctcaggtgatccacccgccttggcctcccaaagtgctgggattacaggcatgagccacctaacccggccagatttaactgctttgaaccaccatctcacacatcttccaggggcttctagttaaatacagagtattaatagtgtataattccatttatgtaagatccttggaatagccaaactcacagagacaaaaagtagaatggtggttgccgggggatggtagaggggaaaattgggagtcatttaacgagtatggagtttcagtttaggaagatgaaaaaagttctggagatggatagttgtgatggctgcacaacaatatgaatgtacttaatgtcggtgaaccgtataaccatttaacaattgaaaatggttataaaggtcaattttgtgttatgcatatcttatcacataaaaaatacagaggactgatcattatatttgctcccttccaaaatcccacctaggttaaagaaaaatatataaacccacaagaacacagggaccaggagaggagatgcattcattggattaggtttggttgtaaaacaaaaacaaaaacaacaaaaacaaaaaaaaacacctgggcgcgatggctcacaccttgtaatcccagcactttgggaggctgaggcaggcagatcacaaggtcaggagttcgagaccagcctgaccaacatagtaaaacctcatctctactaagaatataaaaaccagccaggtgtggtggcatatgcctgtaatcccagctactgaagttggctgagacaggagaatcacttgaaccagggaggcagaggttgcagtgagctgagatcgtgtcactgcactccagactagatgacagagcaagactccgtctcaaatggaaacaaaaactaatataacagtgactttacatgctatgggttttttttctcctctcatcttcaagaaatgcggagacggccagtccagggatgatacagcatcacagtgtcaggaatctgctctttctgtataattgttacaggaaaggggtcccgatccagaccccaagagagggttcttgaattcaggccaagtccacagtgcaaagtaaaagcaagtttattaagaaaggaataaaaattccctactccatagacagagctgcccggagggctgctggttgcccatttttatggttatttcttgatgatatgctaaacaaggggtggattatttatgcctcccctttttagaccatatagggtaacttcctgatattgccgtggcattcgcaaactgtcatggtgctggtgggagcgtagcactgaggaggaccagaagtcactcttgtgtggcctttttggtttggtgggttttggccagctcctttactgtaacctgttttaacagcaaggactttatgacctgtattttatgttgaccttgtatctcatcctgtgacttagaatgccttaaccatctgggaatacagcccagtaggtttcaacctcattttacccagctcctattcaagatggagttgcggcccggcgcggtggttcatgcctgtaatcccagaactttgggaggttgaggtgggtggatcacgaggtcaagagttcaagaccagcctggtcaacatggcaaaaccccgtctctaccaaaaatacaaaaattagccgggcgtggttggcgtgtgcctgttatgccagctacttgggaggctgatgcaggagaatcacttgaacccaggaggcagtggaggttgcagtgagcagagatcgcgccatgcactccagcctggacgacagagcaagactgcgtcttggggaggaaaaagaagaaaagatggagttgctctggtttacattcctctgacataatggctttatgtacatggcttccatggttaaggtcagctcgtggatctgatatggctgtgttggtgatcatgcccagcaatcagaaagagaagggaggccgggtttggtggctcatatctgtcatcccagcacttcgggaggccaaggcaggaggatcacatgagcccatgagtttgagaccagcttgagcaacatagggagacctcatctctacaagatataaaaaaaactgtcggacatggtggcgtgtacctgtggtcccagatattcaggaggttgaggtgagaggatacctggaacctggaggtttgaggctgcagtgagctataatcgcgccactgcactccagcctgagcaacagagtgagaccccatctcaaacaattaaaaaaaaaaaaaggagggcagaaaaagtctatgtaccttttctttcaggttaccttctcaaagttgtgcataccccttccatttacattatattggccagagcttaacatgacaactactagctacaaggtggtttttattctgggttgccatgcatcttagcttgagtaccctacaggcagatcctgagacgaggattcctgtgaaaatgattatttacttatttaattaatttattttgagatggagtctcactctgtcacccaggctggagatcagtggcatgatctcggctcactgcaacctctgcctcccaggttcaagcaattctcctgcctcagtctcccaaatagctgggactacaggcatgtgccaccatgcccggctatttttttttttttttttttgtatttttagtagagacagggtttcactatgttggccaggctgatctcaaactcctgacctcaggtgatctgcccgcctcggcctcccaaagtgctgggattacaggcgtgaaacactgcgcctggccgaaaatgattttttaaaagtgttccaggaagaaacggaaagggcataggggagtaagaaagtggaaaatggaaaggaaggaagccaagcaaggggatcctatcaagcaaagcctcagtcctgcagacagtttggaggcaggatattcacatcttagagttgtccaaaacaggacaggcaagctgcagaattttcaactctggctgaataaggttgcgtttcagctctccgggcacctggaaagtatgggctccagtagcctggaggcagtctgctgacagacacaggtgctggctggtgtgcacaaaagtggtaaagggatgagcgggtgcaatagggacactggcatcttggctgtcatgcatccaggtaaaaagtgggggctcaattactatatatgaaagggagaacagactttaaggaataattatcagtcatttccaggtgagacagcaacagaagagaaatgctaaattttcccttttttgggggggtgcggtggggggacagagtttcgctcttgttgcccaggctggagtgcaatggtgcactctccggctcactgcgacctccacctcctgggttcaagcgattctcctgcctcagcctcctgagcagctgggattacaggcatgcaccaccatacccagctaattttgtatttttagtagagacagagtttctccatgttggtcagagtggtctcaaactcccaacctcaggtgatccgcccgccttggcctcccaaagtgctgggattacaggcatgagccaccgcgcccagcgagagatgctaacatttttttgttttttggaagatgacaagttgatgcaagaatgagcagaaccaggaagctggatactcagtgtttaagagttcctagcaatatgcaggaaaggaaagcaacaagtatcccgggaggtggggttagatgtagactgaaatcaggaggtgtggttaaaactctttgaaagaggctgggtgtggtggctcatgtaattccagcactttgggaggccaaggcaggtgatgacgaggtcaggagttcgagaccagcctgaccaacatgtgaaaccccatctctactaaaaatacaaaaatcagccaggcgtggtggcgcatgcctgtgatcccagctactaaggaggttaagacagaagaattgcttgaacctgggaggggaaggttgcagtgagccaagatcatgccattggactccagcctgggcgacagagagagactccatctcaaaaaagaaagaaagaaaaaagaaacagcagattccctagagaggagacattcatcactaaaaaaaaatatatatatatatatatagagagagagagagagttaaaataattcgcagaactaaaagacctttttgaatgggctcagggtgcccagcataatgtacgaaacaaaagcaaacccacatcaaagtacaccattattaatttcagagcatcagaaataaagagaagatctgataagcttcttggaagaaaacaaggcacagagaataatcagaggagagtagagcaggaaaacagggtcctgggtagagagaactgagtctagccaattgatagaattcttgatgttttgttgaaaacagaagcactttataattctctgggtaagttttagaaagattctgtagtaatggtaaattgtgcaaatttaaaaaatggaacctgttaatttcaggaagaacaaaaggtagaaaaggcaatataatcttggtacaacatttgactcagctgcaatgaataagacttacatagtcatataaggtaagcattgattacttactttaccaataattatgatatcaccatactgaaagcccagaagcaagggaaataaagggaaataccagagtgctaaatctttttttttccgtaagttggtaatgtataaaataataaaatgacaatcataagcctaatgcttagaaattcagaaaaatatcagactaaattttaaagtctactttaaaactgagtttttgctttatagtttcataaataaattcattttgatggttttctcagaacagatgaactggctgagtaaagtggttcatgcctgtaaccctatcactttgggaggccaaggcggatggatcacttgaggtcaggagttccagaccagccaaaaaattagctgggcacagtggtgcacacttgtaatcccagctactcagtaggctaaggcaggagaatcacttgaacctggaaggcgaaggttgcagtgagctgaaattgaacaactgcactccagcccgggcgacagagtgagactccatctcaaaacaaaaaacaaaaaacagatgaattgtttttccttaaggaatactgatgatcccactgcttgagtaatggaaagcagcttgcagctaataagttattttttgtcttttttcctgttctatccattgtcctgggtttgaaatttcagctgggcagctttgatcccaccacctgtagccactgaggttcataggctgtttgagatattatgttcaattgtgctgggtttgttttgctgcttaatgagtgatgaagagcaatgtattcgctactgagatattctgcagaaaaaggaagagatgtcttcagctcaaatgctatcaaacttgtatgtcttttaactttttattataaaaatttcaaacatatgcaaaagcaaaagacttgttcaatgaaccttatgtacccaccacccagcttcaacaattatcagttcctgacaattcttgtttcacctaccccacctctattatacacacatacaaacacacacacagacacacacacacgggagcaaagtcaacttccattattttgaagcacatccaagacatcacatcgcattatttatcacattatttattaagtttcttgggtcatagtctatctcacagaaagaaatcccccatgagaaacttttaggacatagcttttatgttaattacttaatttctgcactagccatccttgccttccttctaattttctgcactagctatccttaccttccttctaatttactaacctgccaaggattctcctgcctcaaagtatttgcatcagctgtttctttctgcctggattgctctttcccagatacttacatgtctcattctttttcacccaggtgaaataaacagccttgttgctcacacaaagcctgtttggtggtctcttcacatggatgtgtgtgacatttggtgccgacaacctgacaggaggactcctctgggagaccggtcccctgtcctcgccctcactccatgaggagatccacttgcgaccttgggtcctcagaccaaccagcccaaggaacagctcatgaatttcaaatcaggtaagcggtcttttccagcctctcttgctacccttcagtctccctgtccttccaattccagttctttttcctctctagtagagacaacagagacacattttatccatggacccaaaactctggcgctggtcacagactcgggaagacagtcttcccttggtgtttaatcactgtggggacacctgcctgatttttcgctcacactccattggtgactgatcatcggggggcacctgccttggtcattcacccacattcccttggtggcaagtcaattgcggggacgcctgctttggctgctcacccacccccttttctgtgtctctacctttctctttaaacttacctccttcactatgggcaaccttccgcccgccattcccccttcttctcccttagcctgtgttctcaagaacttaaaacctcttcaactcacacctgacctaaaacttaaaagtcttattttcttctgcaatactgcttgaccctaatacaaactcgacagtagttccaagtggccagagaatggcacgttcaatttgtctgtcctacaggatctagataatttttgttgaaaaatgggcaaatggtctaaggtgcctgacgtccacacattcttttacacattggtccctccctagtctctgctcccaatgtgactcgttccgaatctttcttctttctctcctgtctcttccttcagtctccaccccaagctctgagtcctttgcgtcctccttttctacagattcatctgacctctcccctcttccccaggctgctcctcgctaggctgacccaggtcccaattcttcctcagtctccactcccccaccctataatccttttatcaccccctcctaacatcccatctggcttacagtttctttccttgactagccctcccccacttgcccaacaatttcctcttaaagaggtggctggagctgaaggcatagccaaggttaatgctcctttttctttatccgacctctcccaaatcagttagcgtttagactctttttcatcaaatataaaaactcaaccctgttcatggcctgtttggcaacaacccttagatgctttaccaccctagacccagaagggccagaaggccgtcttattctcaacatgcattttattacccaacccactcccgacattagaaaaagctccaaaaaattagattctggccctcaatccccacaacatgacttaattaaccttgccttcaaggtgtacaataacagagtagaggcagccaagtagcaacatatttctgagttgcaattccttgcctccactgtgagacaaaccccagccacatctccagcacacaagaccttccaaatgcctgaaccgcagtggtcaggcattcctccaggaccgcctaccccaggatcttgcttcaagtgccagaaatctggccactgggccaaggaatgcccgcagcccaggattcctcctaagccatgtcccatctgtgcaggactccagtggaaatcggactgtccaacctggcagatactcccagagcccctggaactttggcccaaggctctctgactgactctttcccagatcttctcggcttagcagctgaagaccgacactgctcgattgcctcagaagccccctggaccatcacagatgctgagctttgggtaactcttacagtggagggtaagtccatcccctgtttaactgatatgggggctacccactccacattaccttctctttaagggcctgtttcccttgcctccataactgttgtgggtattgacagccaagcttcaaaaccctttaaaactcccccactctggtgccaacttggacaacattcttttatgcactcttttttagttatccccacatgcccagttcccttattaggctgagacattttaacctagttatctgcttccctgattattcctggactacagccacatctcattgccaaccttcttcccaacccaaagcctcctttgcgtcttcctctcttatcccaccttaacccacaatgggacacctccactccctccctggcaactgatcaaacacccattactatcccattaaaacctaatcacccttacccggctcaacgccagtatcccatcccacaacaggctttaaggggattgaagtctgttatcactcgcctgctacagcacgggcttctaaaacctataaactcttcttaaaattctcccattttacctgttcaaaaaccagacaagtcttacaggttaattcaggatctgggccttatcaaccaaattgttttgcctatccaccctgtggtgcccaaccccgtacactcttttgtcctcagtaccttcctccacaactcactattccattcttgatcttaaagatgcttttttcactattcccctacaccccttgtcccagcctctctttgcttttacctgaactgaccctgacacccatcagtctcagcagcttacctgggctgtactgccacaaggcttcagggacagccctcattacttcagccaagctctttctcatgatttactttccactccttcgcttctcaccttattcaatatagtgatgacgttcaactttgtagcccctcctttgaatcttctcaacaaaacaccctcctgctccttcaacatttattctccaagggatataaggtatctccctccaaagctcaaatttcttctccatccgttacctacctcggcataattcttcataaaaacatacatgctgtccctgcctatcatgtccaactgatctctcaaaccccaaccccttctacaaaacaacaactcctttccttcctgggcatggttggatatttttgcctttggaaacctggttgtgccatcctaacaaaaccattatataaactcacagaagcaaacctagctgaccccataaatcctatgtcctttccccacttccctttccattccttaaaaaacagccctaaaagctgctcccacactagttctccctaactcatcccaactcttttttcattacacacagccgaagtgcagggctgtgtggtcggaattcttacacaagagccaggactgtgccttgtagtctttctgtccaaacaacttgaccttactgttttaggctagcccccacattattcctgataccacacctgatccccatgactgtatctctctaatccacctggcattcactccatttccccgtatttccttctttcctgttcctcaccctgatcacacttggtttactgatggcaggcctaattgccattcaccagcaaaggcaggctatgctatagtagtatcttccacatctatccttgaggctaccgctctgcccccctccactgcctctcagcaagccgaactcattgccttaactcaagccctcactcgtgcaaaaggactacctgtcaatataaactgactctaaatatgccttccatatcctgcaccacaatgctgttatatgggcagaaagaggtttcctcactacgcaagggtcctccatcattaatgcctctttaataaaaactcttctcaaggctgctttacttccaaaggaagctggagtcgttcactacaggggccatcaaaaggcatcagatcctattgctctgggcaacgcttatgctgataaggcagctaaagcagcagctagcgttccaacttctgtccctcatggccagtttttctccttctcatcagtcactcccacctactcacagactgaaacttccacctatcaatctcttcccacataacgcaaatggttcttagaccaaggaaaatatctccttccaacctcactggcccattctattctattgtcgtttcataacctcttccatgtacgttaaaagctgctagcccgtctcttagaacctctcatttcctttccaacgtggaaatctatcctcaaggaaatcacttctcagtgttccatctgctgttctactactcctcagggattattcaggccccctgccttccctacacatcaagctcggggatttgcccctgcccaggactggcaaattgactttactcacatgtcccgagtcaggaaactaaaatacctcttggtctgggtagacactttcacttgatgagtagaggcctttcccacagggtctgagaaggccacgtggtcatttcttcccttctgtcagacataattcctcagtttggccttcccacctctatacagtccaataatggaccagcctttactagtcaaatcgcccaagcagtttctcaggctcttggtattcagtggaaacttcataccccttactgtcctcaatcatcaggaaacgtagaacggactaatggtcttttaaagacacacctcaccaagctcagcctccaactttaaaaggactggacagtatttttacctcttgcccttctcagaattagagcctgtcctcaagatgttacagggtacagtcgatttgaacttttaaatggatgcagtttcttgctcggccccaaccttgtcccagacaccagccctctaggtgacaatcttctagtcctcc

SEQ ID NO: 3 - DNA, 39346 bp, mmusculus
ggcggaccggggctgaggggtggggccgggggcggagctgctggagggggctgctccgcgccggggccgttggctccagacaaataaacatggagtccatcttccacgagaaagtgagtgtgggcgttcggtggggagccgtcctcggctcggcggcgggcgtggggagcagcgacgccgcttcaggaactcaggcggggcccgagcgcccccatcccgacctggctgggtgaggggtgcttcctgccttctccccatggctccgctcgtgaagcctcccgcatgcgttcccggcaccctcgccctagaagaccgggcgggtagcctgggcatttcggggggcttcacccggaggattagcgcgggcgttccttgtccacttgccacaccttttcgggtttcttctctcttctctcttagggtctagtctagcgagtcgccttttcagcacctggcggacccttcccaactccacccacgccccctaacctgtcctctggcagatccaactttctctctcaactcagttctataatggaatgctccatgcatttagatcttgattatccatcccacgtctttctgcagttgtgaccgtggctttcccattaaagggcctgacacttcggaagtaaagtaggaaaccccggagggaagtcgtcataagagtttttattacggggatgtttgggttgttctcccatttttccggaccaggaggccagctttgtttttaggtattatggatagattagaatcgttctactgtgtgatttggcttagtctcttcctcaccttaattcctaagtgactacgcttaaaagtattgctgtgacatcttgagaaactggtctatgttcgcatacaattatcaagtcatttgggtgtttctcggacaaccatgtttcataatcattttaggtttggagagggttgctagttgagactattatttcgttgggagcaaaggcctttgtttttatcacttgtaaaggagcattgactcatagtgtttaaaatccacgcacaacaaaaagacaaaaatgatgtgaatctaaggacgttgttaaatgaagtgctcttaagaagacattttgagtgttttggaactggaacaagttagtttgtgacaggatttcttgtagcccaagttggctccagactcccatcgtcctgtctctgcctcctgagagctggctgggatgatggccacgtgctatgactgagtgagctccccctcccggccccctccccacattcatttgtaattaattttccaaaggttttggaataagacccattttaaacatgttatattttgaacactgtatacactgcttcatgagactcttgccattcattctatttaaaaaaaaaagttactgtttgtgtgtatgtgctggtgtggaggtcagggaggactttataaagttctctcttcccaacttggtgtgagttccgggtgtctcaggctcttagcaagcccgtttactcactgagtcatctctagggtgaatgaaaaaagaaatgggaaggacatgacttttcctagggatggcggaggagaaggtttattaaagagatttgggagagcagagccaggggcagacatatttgggagaacccagagtggtcttgaccctgaggggaagggagaaaagggaaggaaatacagcagccaggagccaaagttgcaaaccatacaaaaagagggtgggtaaccaaaatgtatggattacataggcaagagccactaggggaagggcagcatagtccatgctctggagagttcagggtagagggccgggtataccagccataccctgtaacaggagggactaagggatgctgggacaacctggaggccaggtccacttccatatgttaaataggtacctcagccactaagcctgggattaaaacttaacatagggcacttaaacaatgcattaaaaaattatttttggccagcaatggtggtatacctgtttttgatattttatttatttacattttatttatttattttggtttttcgagacagggtttctctgtatacccttggctgtcctggaactcactttgtagatcaggctggcttcggactcagaaatccgcctgcctctgcctcctgagttctgggatcaaaggtgcacgctaccacgcccagctatttacattttaaatgttatcccattttctggttcctctctacaaactcccaatcccatccccccccaccctctgcttctatgagagtacttccccccaccactcccgcctacccgctctggcattcccctacactggggcatcaggccttcacaggaccaagggcctctcctcccattgatgccctacaaggccatcctctgctacagctggagccatgggtcgctccatgtgtactctttggttgatggtttagtccttgggagctctgggtgtgggtgtggggtctggttggttcatattgttgttcttcctatggggctgcagaccccttcagcttcttcagtcctttctctagctcctccactggggactctgtgctcagtccaatggttggctgtgagcatctgcttctgtatttgtcaggcacagagagagttttaagatagccagggctatccagagaaactctgccattaaaatccaaaaaaaaaaaaaaaaaaaaaaaggtgtttgccagggtactgtgtgctcctagtgcccactaaagccagaagatctggaactggaggaactggagttaaagaggccacgtgagcagccacgtgggtgtgaggaattgaacccaggtcctctggaaaagcagccaatactctttgttttgttttgttttttgagacagggtttctctgtatagccctgcctgtcctggaactcactctgtagaccaggctggcctcaaactcagaaatctgcctgcctctgcctcccaagtgctgggattaaaggtgtgcgccaccaccgccgggctagcagcgaggactcttaactgctgagccatctctccatctcccccaataccttcttgacagtactgtttctcattggagcagatttcagtggaggtgactactgaattggtatatgcaaaatgctaggcttacaaagtgcttgtgagtaagcatggaagcccgagttcagatcccagtgtgtgttgtattcaccaatactcgaggcagggaatggacagacaagtgggtttctgggtgctgccccgtcagtcagtccagctgaatggtgagcactagactccactagaaaggtggagagcagctgaggaggacatctgacttagacctttagcacatgtatgaatacatctgcatgtacacatatacacaagaacacatatgcagacatgagtgcacagatacacatctgcttacccagaagtcattcagttatcagcaggtgtatatacttaataaatacttgagaagtacctttgccgtgtgtgtgtgtgtgtgtgtgtgtgtgtgtgtgtgtgtgtatgtgtatgggggtgcacatgtgcatatgcatttagaggcaggaagacaacattggtggtgttcctcacaagtaggttaacttaggacttccaggtatctgcccatttttacctctccagcgctatagttacagatgggtaccgccatgcatggctttttacatgaaggttctggggattaagctcagatcctaaggccagtatggcaagcaccttattgattgactaagctcagatcctaaggctagtatggcaagcaccttattgattgactaagctcagatcctgaggccagtatggcaagcaccttactgattgactaagctcagatcctgaggccagtatggcaagcaccttattgattgactaagctcagatcctaaggccagtatggcaagcaccttattgattgactaagctcagatcctaaggccagtatggcaagcaccttattgattgactaagctcagctcctaaggccagtatggcaagcaccttattgattgactaagctcagatcctaaggccagtatggcaagcaccttattaattgactaagctcagatcctaaggccagtatggcaagcaccttattgattgactaagctcagatcctaaggccagtatggcaagcaccttattgattgattaagctcagctcctaaggccagtatggcaagcaccttattgattgactaagctcagatcctaaggccagtatggcaagcaccttattgattgactaagctcagatcctaaggccagtatggcaagcaccttattgattgactaagctcagctcctaaggccagtatggcaagcaccttattgattgattaagctcagctcctaaggccagtatggcaagcaccttattgattgactaagctcagatcctaaggccagtatggcaagcaccttattgacagaggcatctccccaatcctggagacttcatttgcctttgtcattaatttaactgtatgaagcaagtgaacacttaatgaagtcatagcatatttcttttttcttttttttagatttctttttttaagcatttattactatatataagtacactgtagctgtcttcagacacaccagaggagcatcagatgtcattacggatggttgtgagccaccatgtgggtgctgggatttgaacccaggatctccagaagagcagttggagctcttaactgctgagccatctctccagcccgccatagcatatttcaagagaatgtacctgtgactgtagaagagaccagactgggaatatttaacataattgctattttccagagaattcttttcccttccataacttgcctttaaccagtaaattaactagagaagatatcaaccactttctcatggagttaattttacacttaacccctttgaatgcttccttttaaattagacataaaagcagttgtcagccaggcatgatagcatatgcctttaatcctagtacttgggaggcagaggcaagcaggctccttttgtgatttttttttagattatttggaagagtggaagtgtagtgtgttcatcttctgagcctagcacagtaaaatgtggattccccaactcatagaattttaatagcaaagagagtttctcttgtgtgaaatagaaaagtgttttattatattgtatcgcatatgtatgtaggggttctccatgcatgccactgtgtacatacggaggtcaaaggacgggttgcaggggttggtcctctcctcccactgtgcgggtccttaggtctgcatggtcacagccttttggttcgtgtagaatttttttttcccccgagacagggtttctctgtgtagccctggctgccctggaactcactctgtagaccaggctggccttgaactcagaaatccgcctgcctctgcctcccgagtgctgggattaaaggcgtgcgccatcacacccggcttcgagtagaatttgacagcctgtggctctatgatttttaaattgacttgaacaatttgttgtttccgtccattaatcatatcagaagcagtaccattttacttggtcagggcttcattttaagtgcttatttttcataataaaaaagctacttgttttagagactgaatgtagcacatttggtagagtgcttgccttgcgtgaataaagcttaaattctatccattcccaatacacatgaattgggcataatgagataggtacttttgatttttttaaagatttaattatttttatgtgtatgagtatcttcatgaatcaagtgcaccatgcgcagacagtgactgaggaagccaggagagggtgccagatcctttaggactgcagttactaactagtcatgagcccctctgtagattctggggacagaacccaggtcctttgcaaggatatcaagtgttcttaactccatctctccagcctccaaattccaattattaataacaagaatgttttatcaaaacactggatgccattatttctgtatgttaaagctggtgaccaggagctcagtggttataagcactggctgctgtggacccagggtccccagcacccatctgatgacttaaaactgtctgcaactccagtcttagaaggtccagcatcgtcttttggccttcgtagacactaggcatgtacatggtgcagacacacatacaagcaaaacacctatacacataaaaaccatagtttatgacccccacactgaagcatattgcctagcaataggactgaggagtcatcatagctggtccccaagttgagtgcctggttaccatgttagatagttgttgatttccttctttctttctttctttctttctttcttttttttttttttttgtctttttttcaagacagcgtttctctgtatagccctggctgtcgtggaactcactctgtagaccaggctgtcctcgaactcagaaatccacctgcctctgcctcccaagtgctgggattaaaggcgtgcgccaccaccgcccggttgttgatttgagacaaggtctcactatgtaggtaacaggccaggaactcacaggagtattcttgcctctgcttcctgagtactgggattaaagttgttactgccatgcccggccctcttctttgaatgttttaaatcaagcatttcacatacaagaacacacaaattatgagaatgtgcagttgagggagcacacatggaaacagcccttgggtgaagtcacagactgtttccctgaatcctcgacaccccctgtcctttcttccagctcttcctcagtgcttacttctacaagaaaaatctgacttcctagactgagattaatttcccctatttaaagcttttgtaaaaaaaccatgtaagtctttaactccggcatttgggaggcagagccaggtggatctctgagttcgaggccagcttagtctacagagtgagttccaggttagctaggctccacagagggaggttgggggaaaagaaaaaagaaaagaaaaggaaaaaaacatggcatgcacttaaattttttactactgtgtatctctgcttgatatgttgtatgagtggacacatacaccaaagttctgtatagagatcaaaggggagctttgtggaattcccttccactttggagtcagttccaggcataggactcaggtcttccctagggtcctctcatccaccccatcctgcactttaactgtctttgattggtgatagttttggggattgaacccaggtccttgtacagactagctccatccttagctctggtgtctactcttttgagtgttgtgtgttttttactttttaacagtgtttgagagattcatccatattgttatagttgtgtttaatttacttttattcttatagtgttcttttgttattgtaattctgtgttcaaactgtctttgggtgctttccagtttggaaagcctgtaagtagtgctgtagtgagtgcatcggcagtgtgtctaatcacagcacacagcgttaagctttggtaacgactgaggattgttgtagagttggttcactactttatactcgctcctgtaacgatggctttctgtcattctaagcctcccactgtaatagctgttttggagactgtagcagtaacaccatgtgagtgtttcttttgtaaaagtacttttttttcttagctaggtgtggtggttgtattattagtcagggttctctagagtcacaaaacttacggaatatccttttatgttgagggattttattgtaatgacttacagtctgtagtccaactaacccaacagtggtcagctgtgaatggaagtccaagaatctagtagttgctcagtcccacgatgctagttgtttcagctggtcttctgtagaagtagattccaacagatgtgctgactagtaagtgcaagcaggcatagaagaatgaaacttccttttaatgtccttaggtaggccttctgcagaaggtgtggcccagattaaaggtgtgtaacacctgcctagatctgggacttactttgtctcaggctgaccttgaactcagagatcttccctcagtctcctggggttaaaggcaagtattaccgtgcctgaccactatgcctcaagatctccatgtcaagatccaggtcagaaacttgtgtcttttggcctcaagatctggatcacaggttagccctccaattctgaattgtaactcatttcagatatagtcaagttgacaaccaggaataaccattacggtggtgtgcacctttaatcggagcactcagagtcagaagcaaacagatttatctgaatttgaggccatcgtggtttacatagtgagttccaggctagctagagctacttattgagaccttgtctcaaaaccaagtgagtgcaggcctacacgtggctaggtgtgcatgtggggacaggtactcaggagccagctctgtctttctacagtagtattggggattgacagcaggccctgttacctgctgagccatcttctgttgtagtttggtatacatttccctgatgactaatgaagttgagcatctttttgtatctcttagccactagactatcttgtgaaatgattacatttccactagaatataagtagaacatctgtctgtccttacctcatagtaattggtattcagtggaagttgcttctagtaaatcaacattaaaggaggcaaagaattctgaggataagttgttctagctctctgtcagactcaagctctctgaactctcccttcctggtccatagcagacaggtatgctatatctacttcagcaattacattttgtttctgtaggagtgatacattggtgtgtgtgtgtgtgtttggggggatgcatcttgcaggtgctctctggagtcatcatctgccatgtaacatagctcaggccagggggcatgttgtcaggcaggttgagttcagtaggcctcactggccctttagagggccagagttaacagaaggaagtgttttcccatctgcctttgccttccgaaaggcagagttagggtctgtgtccacaggactcatctactcatgtgtctcgttctttggaaagcaatactgttggtccaggagaatgacaagcaagctgcccactatcaggcagtctggatatagagctggactgggtgccagttgtgtatgaaaggcagctagccagtgcaagaagcccctggacctatgggacattgtgtccacccgtcatggggaggatgttaatgaccccttagggagctgaagttggctgcagttcctcttactgctgtctactcgtggacatggacttggggctgttgagagcctctgctctagaactgtgggccttaacttaaagtgagacaggattgttctcgcttacccagttcttgaatttgaaaggacaggcttttaaggtcaaacagcaaccatcttgtcacaagaatgaatgttctagaggtttatgctccctttttgcagtagtaatttgctgtggaatttctaaaggtaaattctaataggtactgaaaaattcaaagggtaaatgtttttataggttaatttttaggtttatgtgattggatagatgaattatactgtaaaccgttcttcatttttgttcctaaagtagctgtagaatatacatgggcaaggaaaatgtatgtgcttgtgaaatctggtttgcatggggcttacaaagtttgttttgactgccttaaaaagttagtaattacattttttaggagatattgtacagatcggcttgatgacatttgaatgttttcttttggaaacactagcaagaaggctcactttgtgctcagcattgcctgaataacctattgcaaggagagtattttagccctgtggagctatcctcaattgcacaccagctggatgaagaggagaggctgagaatggcagaagggggagtcactagtgaagactaccgcacatttttacaggtactgattttcgactcactgagccccattttattgtggaaatgcgggtgctctttagaggaggatgagccgttctcccccaggagtctgactcggtaattatcactctgctcctcctcacttgggaaatggggttgtacagcgtgttcttttaaacgtgcacactaattttaacccttttcccatccccctctgcccacaactactgcccatgaaaattgaacagcagccttctggaaatatggatgacagcggctttttctctattcaagtaagtagtccagagtgcagcgctgcctcatttccagccccgctttgtcctgaggctcagttgtggttgatgtgccacagtgtgccacagctctttatgtaacgatggaggcttctgcagctccttctgtaaactgtctgcagaagataagacactgcagagtgctacacgtacagagatgaccacaggacagtagactcttcactttagaacggctttgactgctcacatgcttaggacaggcaggcccttgctgcctatacagtcctcgctggtctgagacttgtgatcgtcttcccctctgtgtctccagactgaaattataggtgtgtgctaccacagtcagtttagagtggggcttttaaaaattactttctaagagagattgcttaatttgcatgtaggtgctaataactctaataaatttcagtgcttcaaactccccatctctggcatgtctgagaaattgcagtgtcttgcagtcttctatttaaatcatcctccaggattggattcctgttgggtaggttgtagccctctgaaggctggtatggagattgccctcaaggccttgcatgtgccgagctcaaactgaccccgagccacatcccagtactttacgttctatttatctgtgttggtttattctttttagtgctggggatgatatctaagacaatattctgctctagagaaaatctccagccctgtggttatacatacatacatacatacatacatacatacatgcatgcatatacgtgtgtgtgtctgtgtctgtccttctgtagcctagcatggcatggccttgaacaaagccctgctgcggcatcccagttgttggggttgaagtctgggcacggatgcctgacttcgtttgtgtacttgtgaagtccattctgacaatgtgagcgttgtccaaattctttctgaatctgtcttttgagagatctacttatgcaagtgtctttctttatactttccttctatgccacccttctagagtcctcattctctagcatttccacccagtacttcacttgtgacattgtgaggcccagtgggcttgtgctgagagtacaggtgagagccagcagtctcctgtggtgtcctgtgtggcactgcttccatctctgctctctcgcacttgcagttggtctgagttgtacatgtttctttgttgacttcctgggataacaggtggaatgttgtcttaatttctctctttttttttttcagcttgctatcatcaggtttgattttctgttcatggaagtttaaaatacatcaaaccttctttttaaagatttatgtgcccatgtgtggatatgtgcacatgagtgctggtgtctgtggaggacagaagagggcactggaaccctgcagttgacattacaggctgttgggagccctgacgtgggtgctgggaactgagcttgggttctgtaagagcagtgtatactgttgaccacagtcatctccccagtgcccagacctttcttttcaacccccagggagaatttatttactatacacctttggtgactgccattgcaggtagtaagtgtaggaagggatagttttacaaacagcacccacagtgtggcgtgcttctggatgtgtgagacagtgttatctacaaattctctgcttttctgacattcctcagaatggaaaagctctctttcaaaatggatgtgaggggctggagagatggcttccgtttaagaatgcttaatggtatttcagaagaagaccggctcagttcccagcatgtacgatagactgcttacaactgcctgtagctcctacatggacacctgatgccgtctggcctccacaggcactcagacacacttagataaaaaataataaaacaatacatctttaaaacttgcaatgaaataaaattaagttcacatgtatatattatttatggatttagtggggtgtcaagggaacataatttgtaaaagctatatcctcaaactatatatgaagaatagttgcttatagtagctgtgctacttaaacttggacttgaaggtttagctcatgaaaagttgttatttttcttttgacaggttataagcaatgctttgaaagtttggggtttagaactaatcctgttcaacagtccagagtaccagaggctcagaattgatcctatgtaagattttttcctatatttctttatttagatttgatttttaaagctgtaatttctgaatgaggacaaaatcatcatgaatgtctttgctttattctgtatttgatgcccttagacttcaccccgtcacctttttggtgcctttcttcagtgtcagtggtggccctgccctgagtcctgtgggggctttgtgcttagcatcactaagctcctatgggagacgcatagtgatgcgacttttattttttcaaataagtaattaagtattaataagtaattaagtatgtcattaagtaaatgataggagatacttgctagtacatctctactatcccaacttaacagtatatgttttgttttcttctagaaacgaaagatcctttatatgcaattataaagaacactggtttacagttagaaaattaggcaagcaggtaatatatcttctattttcttgtccttttatcataatctgtactctgtttgaaactaaaatttgatattggtctctttggaatgtatcctaggattctgtgcactctacccaagtctggactcaatttaacagataaaaatttcctagcttaagagaagataatcatcttctcttcagatttttaaaaataaacctatatatgttatgtcataatgaaaattttgtagtaaaaacagtgcatatgtggttaccgttacatatgtttttgtgtgacgatttgtgtttagcatagtactacaacaaagcctgagatcatggtgggaatgcgcattacgggatgggcttctttaggcgattctagtgtctggcagtacttacatctgtgcacagttaccactgaacgtggctttaaactagtcacgtaaggccttactagaatgttagagcttgctaaaggttattgaaaaccagcttatatagtcaaagggaatgaactgctaatatactcgcagcgtggatgaatctcagaaatgggagctaagacctaatgacagaaagtagaccgactagtgcttgtgtagggctgaagttggagagaaggcacagagggacctggagacgggactctgatgagggtgctccagtctcggtcatgttgatgtgggtgatagagattctttgaaacgacaaactgtagaagtggaaatataattatgtgcagttttatcccagtgctgtggcccacacctttgacctaggaagaccttgagaccagcctggaccacataatgaaaccctcaagagagatgggggagcgggaaggcactttatgtgccctagtaaaactgttatttaaaataaaaagaaaggggctggagaaatggctcattggttaagagcactgactgctctccagaggtcctgagttcaattcccagcaaccacatggtggctcacaaccatctgtaatgggatccaatgccctcttctggtgtgtctgaggacagctacagtaaactcatataaattaagtaaatgacttaaaaaaaaaagaaatataaaagattattaaaaaatataaaaaaaaaatgtcgagtgtggtggtgcacatctttaatcccagcagagatctctgtgagctcaaccaaagcttcagagtgagaccctgtgtttaaaaatccaacaataaataagaaacagaacattgaacctggagatgtggctcagcgagtatgactttactgctctctcagaggacctgagtttggttcccagcacccacgtggtggcttataactgtctataactccagctctgtggaggaggtgcctttgggcaccaagcacacacatgatgcacatacatacatacatacatacacacacacacacacacacacacacacacacacaaaattaatatattaaaaagaaagaatacagtgagttaaatcaatatatattaattatatattatgtatatatatgtatattgatttaattcactgtgttctttctttctttctttctttctttctttctttctttctttctttctttctttctttctttctttctttctttctgttagcttttaattcagtcacctggaaggagccagtcttcagtgattgtttgctgatatagatcattggcagtgatatacttataataagcacaagaccctaagattccacctcttgctccagaacaataaggaaagagcaatctttaggttctttgtaagctgcatagggagccagttaagagcggtgtgtatagtaaggtagcttagctggaacaggaatcaattatgaaaggtccagggtcaacttcatttaacttctctgcccttctcccttgtagccactgagggtttatttgtgcctttagaaaattatgacccagggctggagaggtggctcagtggttaagagcgtggactgcttttccagaggttctaagttcaatttccagcaaccatatggtggcttacaacatctgtaatagggtctgatgccctcttctggtgtgaagacagctacagtgtactcatataacttaaataaatctttttaaaaagaaaaaagaaaattatcacccagcattattttcctgtatcaagtaatcactggagttttaaggtctggaaatttaaaacccataaaaacttagtagaaataggaaaacattgttttgaacttttacaatttttagctcatttttggattttttacattttgaactagttttagtttgtctttgacaggtacaaagatagcaagaatatgtatattgatccttgattctgattcctattcttgtttaagaacagagttttagctggatgtgatggcacgtctttaatcccagcactcaggagggcttggctgatctgtgagttctgagcccagcccctggtcctgtgtaaagaaaggaatgattggaaaggttctttggctggggtcagaatccaggaagagcccttagttgtgcatggagttgagcatgactttttgcatttttctgttttaagttagggcacctctgaggttgtgacttacctaatgctgttaatcacatgtagcaatagcttagaggtcttgttagaatgaagtgctcgtcataaattctctccgtagagtgtcttttagaaattggagtcttttggccaaaggaaaaagtgtgttgctgtcatttttttgtctgtcaatatggcaggagtctgtgtgttggcctgacagtgtaaaacctcttagttacagctatcaaaaagggcatcttaagatactgccagttgctctccttttagaagttcaggttcttgtttttagaaaagcatttaatagtgacaaatgttcagcttttttttttttttttttggtttttcaagacagggtttctctgtatagctctggctgtcctggaactcactctgtagaccaggctgtcctcgaactcagaaatccttctgcctctgcctcccgagtgctgggattaaaggcatgcgccaccgcgcccggcttcagccttttttttaaagtcatagtattcagtactttaaaaattctcagtttgatatatttctattatttctatagtcttattaaattttggtgggttatatgcataacatgggaaattctttttacatataatattcattaacttaaatactgatttttttttcctagtggtttaacttgaattctctgttgacgggtccagaattaatatcagatacatacctcgcactattcttggctcaattacagcaagaaggtaaataagatcaaaagtttgcttttaaactttaaaagtagcttaaatatagctgagtcatgaattgtgactacagaagcactggtctccgatttgtgagtgtgacggtactgatttctggctgtggtttgagtgacgcagttctatgtgagtgctccctacactgggacatcccctgagcctggggcttcctttccattcctaagtgctcttttgcttttccgtcctccccctcacagggctcacaggaggaggggcatgctcctctcattcctgttggctcattttcagtcactgttcacttggtagattggtgcctttgagtaaccacctggattcgccatgccttgtctgtgtaggcatctgtgagctgccatttttattggagagtttggatgtctagttatctgtctcttttccttaaattcttagtcatttccacaccagtaactattcctctttcaaagattgttttgttcactcttgtcttggcattgccaatgagtgtaactcccttcagattctagtcataagcatcgcagtctttgaccatcaccttctaccttcatgacagtttgctgttccgaccaggctctgaagttaccatgagatccagaactcctcttaaatgattcttcaaggtgttttgttttgttttgttaccatgagatccagaactcctcttatatgattcttcaaggtgttttgttttgtttttgtttttttgagacaaggtttctctatgtaaaagagccctggctatcctggaactcactttgtagaccaagctgccttgaactcggagacctgcctgcctctgcctcctgagtgctgggtttaaaggcacgcaccaccatgcctggtgattgttttctttttttaaagattttaaaaaatttattttatgtgataagatgtttgcctgcatgattctgtgtacactacaagcatgcagttctcaaaaaggccagaagagggttttgggagtcttggaaatggattcacagacagttgtgagtcaccacggtgggtgcttggactagaacctgggacctctgcaagagcagccagtgctcttagctctgagccatctctccagtccctgagcctgtgttcagttgcattcgctggcttctttcctcatctttcctaaataacaagaatcttgaccacaggtaaagtagctcgtgaccctagacgtttcctgtatcatagcagctgaacatggcttcaaacttaggtgaaatatgttggttataattttgtgcttacagctttcaaatgaccccttgatagttatttcacaacttagctctccatttgttacacattgctattctttctggctttctcttgtattcttctgagaacatagacatgattccctttctggtagcagatctctctctttgtttctgtagcttgtggtttgagcctattaaaataggtgggcgtggccctccgtgtaaggtcagcccttcaacatgtactgtatccctgtggctcctgttcagtcaacattcagtttttgtctaatgctctcctgggttgaacattctcccactcccttaaaaaaagtctatgcatgggtaaaaatccctttccctccccctccattgattaaaaataaagtgcttttggtaactatgaaactttagctgcttgcccatttaaattttttccagtagaattatctatagtgcattgtctattgaactcattccacttgggttgtgctgtaaaccactcatcttcaaaagtctctcttctcactatccgggtgacttctacattgccagtgccaggattcaattcttagatctcctagtctaaacagaacacaataaacttgttattaaaaaacaaacagggctggtgagatggctcagtgggtaagagcacctgactgctcttccgaaggtcctgagttcaaatcccagcaaccacatggtggctcacaaccatccgtaacgagatctggcgccctcttctggagtgtctgaagacagctacagtgtacttacatacaataaataaataaatctttaaaaaaaaaaaacaaaaaaaaaaacaaacaaacgaacaaacatcccaaactaaaaacagatataaaaggcgaggaagtgatgtgccttcctgtgcccttcccctcatggcctgttcctttataccttgtccacttaaggctctaaaagtaaattctgtttgtttgtttatttattaaaaactacacactggcactatgattatacctaaaagtgttgcactttctggtgatggggattggaaatcccagttgtgcgtatgtgatgcagagctccactctgctttgtatccccagctggctagccacagagctgtgatgtcacagatacacagctttaagttccgtatccctcacctctgatgatttctttcacacgttaatctgagttgaaatcaggttcaataattgtattgggttagttgtttgttttttttcctaaatcttcttataagtttccttgtctctgttttttgcctttgatgtatttgccagtgttttgtcagggggatattgggttgtttgcctgtttactgcatcttggtttttttcttgtgtattttctgactgctggatgctctatagtgcctggacctgagatgtaggtacttaaccatgctcaagctggtttgggaattgtcttagtcagggtttctatttctgcacaaacatcatgaccaagcagcaagttggggaggaaagggtttattcagcttacccttccatcaccaaaggaagtcaggactggaactcaagcaggtcaggaagcaggagctgatgcagaggccatggagggatgttctttactggcttgcttcccctggcttgctcagcttgctctcttatagaacccaggactacaagccagggatggtaccacccacaatgggcccgcccgccttgatcaccaaccaagataacacagtggccttacttgtgggcatctgcctgtctcaccagttgctgcttttgaggatcatccttctcttcccagtgtgtaacgttggggtgacctgggctcagttcagcttcttccttaggtgccatttcattgcttcaatcacagcctatgatctgtgctcccataattctcagaatttgttctttagcctagacatttcctttggaacacctttgtgtggcagctcaggaagatttcaaatcaaacaggtccacaaaagacatttaaaatgtttattttaatatttaacgcgtatgagtgttttatttatgtgtgtgcctggtccccatggaagccagaaaagggcatcatcggatcccttggaactggagttgcagatggttgtgggctgccatgcaagtgctaggaatcacatgtgaatcctctgcaagagcagcgagcgctgttaacctctgcaccatccctcagagtggcttacccactgagccatctcaccagccccacagagtacttttataaaaacaaaatgtatattatgccatacccttacattacctgttagtggtttcctcgaacactcaaaataaattccaaagttgtaaataaaatccagaattactatgctgtttgtataaggcaggatatcttctcaggacgtgttcactaggtaccatagtgagctggcatgctgattctaggatttagaaacagttttgttagcagaaaacagattaagacatctgaactctgattaagcttgttcttaaaaaatgttaaacatagccgggcgtggtagcgcacgcctttaatcccagcactggggaggcagaggcaggcggatttctgagttcaaggccagcctggtctacagagtgagttccaggacagccagggctacacagagaaaccctgtctcaaaaaacctaaaaaaaaaaaaatgttaaacatattctttttagtgagcagccttctcattctttgtttcattgaagtacaagaaaaatcaatagtagaaaatgtttttaaaaaattaaacttaattgtggttgagaaagcttagcttattaggtatgtatttattaaaagttgctttgtactagtgtattttttttttctttctaaaccacaaggcacacaaactagattagggtactggcttcccagctcctgtttttggttagaaggcatctatgtatggggcagtgagcagggtgccatttccagcatgttttccagtgatttgtccattttagcagtcactggacatactaaccaagtgtgtcttcacaccagccatgtgagggaggttcctttatcctccttcaacaaagggtgccagcagagatgggtgagatagttgacaaaaccctgtggcaccggcaggtggcagagctaggctaaaacgcaggcagtcaattccggatcctcctctttagactgtgttcaggctctgccctcctagggaccttgtagactgcctttgtttcttgtagcccctgaggcttcgagatgagaagagtgatcctgtgtgacttaccgtagattaccttcctaatccaagcgagagtcggcactaaatcaggtcttctgtttttcctactgtgctctttctgtcagctatcatttcaaacaagtttgaattctttactagttgttttagtttgtttttgcctctttttaggttattctatatttgttgttaagggtgatctgccagattgtgaagctgaccaacttttgcagatgatcaaggtccaacagatgcatcgaccaaaacttattggagaggaacttgcacatctgaaagagcagaggtaaaactacgcgtgagtgtggcgtgtatggtggagcaccccttagaagagttaaaggtccatgcgtccattccttgtgtctgtgagtgcatgcacatgattgtgagctgtgtgatgtgggggctgggaaccgaacttggccctttggagagcaggacgtatttgaaccctgagccatctccctgccatttaatgtgtgatcactttaccgttggtgatttgggtaatttgtattttgtgcatttcttttgtagtgctggagatcagcctcttgttcatactaataaatgttctattcagtttatgttcaatctcctgggtttgttttgtattgttttgtcgagacagggtttctctgtatagtcctggctgtcctggaactcactctgtagaccaggctggcctcgaactcagagatccgcctgcctctgcctcccaagtgttgggattaaaggcatgtgccaccatgcccagccttcaatctcctatttttatttatttgtttattaattttttttgatcattttatttatatgaacacacttggatggagggctgggagtttgcgcgtatttaattttaagtatttatttgacaattttatacatgtgtataaatgttttcattatgtcgtccctcactaccctcttttatcccctgtctgttccctctgaatccctcccagcaggtccgcttcctatgctcattgctatttcttctcttccttctcctcctcctcctcttccttcccctcctcctcctcctcctcctcctcctcttccttcccctcctccttctcctcctcctcctccttcccctcctccttctctttctcctcctccttctcctccccctcctcttcctcctcctcttttttcatcccttctttctcctccccttctttctcctcctccttctcttcttcctcttcctcctccttttctccttcctgactcactgaggtttgcttacacagccagcctaccagtggttgtcccattgaagaaaagttactccccctcccttagcagccatagctcttcagctaggcatagggacctctgagtactccctatccatgctggaatgttgatgaattgttcttgtgcaggttttgtgctggtaactatagctgctgtgagtttatgagagcaacagacatattatagtgagaaaataacacggcagcatttcttcctaatctcctgctcttacatcctttctccctgctcttccgtgaagttccttgagccttagagggatgatagagatgtcccatctaagtctgggcatttagcggtcacttattctaaaacactttgaatagttctgctatttgctaggggagagggcagcttttcagcccaaacactaacctgtaggtctaactctatttagaagggtgattgacatgtctgtttattgaaactgcagtagttgtttcccctaccgaggacctgtgaccaacatagccatggacttttgaccaagtttatggtaccaggtcatacctacagaactacctaatgtggagtggccctcaaatccagtaaaacgatggttgggccaggcctggtggcacacctttaatcccagtacttgggagacaaaagcaggtagatctctctgagtttgaagccaaccagctctactgagttctaggacagccagagctagataatagagagacactgtctcaaataaataaaaaagaaagagaagaaaaagtggttgtttgccccataatagtcacgtcactcttgtgtagcagaagaatattacagcatcacatgggctggtttagactattagtgattttcccctccagcagcctttgtagaatctttcagcactgtgaaagcttgtcagcaaggtggaatcttctagcgcagttccagcttggtttctgttatgtaaccaaagtgttacataaccaacatctctgccaattaggtcttactatttagttctggtgggaaactaagaacgatgtctgcaaagaagcagcttttctctgagtggcactagtctataggtctgatgtgcttagaatgcagtttgacatggtcacatactatttgaggagcctctgtatttgtttgcttcttgatataagatctcaagtagctccaactggctgggagtacatatgtttgtgcctccatgttttatttatggtgatggaaactgaactcaggggattgtgaatgctatgcacatattcttcccactgcatttcatctccagcgcttacctcccccaaccaaaatgatttagtgtcaagtgattatttgtagtgttttggctctaatcctgcattttatgcatatactcttatcattgaacagttccttagtcccttccctgttcccttctgttgaaagacaggtctcattaagttgtccagttatcaaacttgacatccttctgtctttggctcaaaagtagctgatactcaacaagcatatgccactctgcccagggaggctgtgttttagtgaagtttatagaatcaacactttgaattcctagaatacattaggtttttatcagcactcagttgttgttagtagaccttatctaatagagcatgttttccatttaaaatctttcatttgcaagtgccttcatgtttatcagacttgatctaaagttgaagaatactggactagagagatggcttggtggttaagaggactggctactttctagaggacctgggtttggttctcggcacccacctgctcgctcacgaccttctgtctccagtgtcatcggatccagcaccctcttctggcctcctcaggcactacacacacattgtgcaagacatacatgcaaacaaaatatccgtgcatattggttagatttttgagacaggatttctaggctgtaattactatgaattcatttgttgtttagtgccctcaaagcagacctggagcgcgtcttagaagcagctgatgggtcgggcatatttgatgaagatgaggatgatttacagagggctctagccataagtcgccaggaaatcgacatggaggatgaagaagctgatctccgcagggccattcagctcagtatgcaaggtttggacatgttgatgtgtactttagtcatttttggagaagtggatcacgtccttaacgtttctgaaagttagtgcacttttggaagttctttgatagttactgcaaaagcaatagctccaaactttgagcatttctttaagattttcttgatcttaaatcatttttttataacttgcattatactaggactgtattgtgtttaacacatttaccattttggttgtggttatgctgttgagtatgatactgagccaatacaacactaatttaattacttttctagtgaccagatgccccttacccaagccagctgttttaataaattcacacagcacttactggctataaagacttatatagactatacagattaagactccagccatgtcacaggatgcatctttttcattgatgtaagcgctcatcatcagtggaggaaagggaaggcaaagccccttagggtaggcagagaaaagtgctgagacactcaaagccgttcctgagagcacaaagcactttatttttgtgattttgttttaatctaattcgtatgaagctgtttctacttctaatgaggttgctcatcatctaaattcctcaaaggtcttagtgtactgaggttttgttatgatggccattatcgttatcctagactcctcacctccaggctcacctctgcatactcttgtggtgtgaagtcccatgttatattaggaggggcttgttgggttattgaagtaataaacagaaaaccatcttaccattttcacaatttacatagaatctgtgcttggtacaattactgttgagagcttagaaacattcaagttgttaaaaacagatgttatggtcatccttcaaaggttgtgaggaatgccttgcctttgaaggtggagatgcaagttaaagagcacagaagtgtggtcttgatacttcttatacgaggtgaacagagagcttgtatcctcacatctgatgcatcacagatcgcatcagccttgcttgcagtaacacattgaattgtaagtccttaattagatttctaagacttccataggctttttaaagttacagaacagtagtggaatgttttaaaactttctagaagcttgctcctataagaacaaacatactactgcttgtacaggtatataaaataattttttgtgtttgtttttaggtagttccagaagtatgtgtgaaaatagtccacagacatcaagtccagatctctcttcagaagagctgcggaggagacgagaagcctactttgaaaagtaaagtagttggtacagattaaagttgcatatttaatacctgctgattttgtctgtttataaattactgcttaccgcctgaacctatgaacgtaagaatatattttctaaaattttttcagagaataaggtgtgaaatacttaatcgtttggagaaaaacgattgccagatcttggataaatttatatagactaggataaaggaaaccttgtgaaattttgcttatcaaaaggaaaatagacttaggacaagcagaactatgtcagtgcctattgatcctttgtatgtagcgttggtcacctatgagtcctgcttaccttctcatcagtagacagggaaaacagcatctgagggaggtggagcctcttcccagtgcagtggcacatgctccctagtctttctcttgtcgctttaggaggtccaagtccaccagcatcagcggcatagaagcataaatctgagccataagcttccgaagctatacgttgtactctgtctatacgtcctcggaagagaaacacttccacttttatagtgtcttcctttacagtaatcatcattcacaagtctttcttttattttttggtttgggcagggctttgttatgtactcctggtggcctcactgatggctatcttcctgtagtcctagctggtctcactactggtggctgttctcctgcctcagtttcccttgtactaggacaggtatatgttgtcgtacctagatttttattttaaaccatactccaccttaaaagttaaataatccatagtagataattgaaccctctgacctcaggtcagaaaggtaaggccagggatggactctgcctggttatataccacatctctcaattcagccatgcatttattttcacatttcaaaatctctgaaaagatgggctttttaagcagctcaaagggcagtgctcagccagtatgaatgagcccccagcccccgagtgcagcacagcagcccctgagcttgagctgattagtaaggcttggactgttctgcatcggctagtgtctgaaggtaatgtttaccttgttctgtttgctggttttttaagtcacaactcataagtatatgaaggaaagttctgatcagctgacatcctcttaatgtgagatatttctagactttattcagtcactgattaatagatttaattatatttacattttagaacagtcttttagtgttttttatgtcctttgagtttttgaaattattactctttaaattatgataaaccttagatttatgtataatgcactcatacttgttactcgttgttggttgagaccagcacacagcccagtttttatgcctctgactcccgttctttccgttctcccacggcatcgggcttgctccaagtcacagtcagcgtgtcattactttttgtgtgtgtctccaaaatattgtgggacgtgtgcttgcttgtgatctgtagggttgcttctggctttgtttttgtgtttttttgagcaatctagctcactgctgtgcaagtcctcaactcctgattatcctgactctcactccgagtgctggagtgcgggtgtgcacaccacatctgacttgactgtttctctctttatttctcctaattagtgctgttgtcacaatatagtaataacaacaacaacaacaacaacataaatatctagttttaaaaagaacttaaaattacttaagtaggcaaaatgagtattctagaaagtttaagtttcttaaaaagtttgttcctgccaggcagtggtggcacacgcctttaatctcagcacttgggaggcagaggcaggcggatttctgagtttgcggccagcctggtctacagagtgagttccaggacagccagggctacacagagagaccctgtcttgaaaaacaacaacaacaaaaaaacaaaaacaaagtttgttcctactatcccttccttcagtaagtgttgttagtgactgtatattcccttctgtcatacacatattcatagtctctctctcagtgtgtgtgtgttcatgtgcgtgtgcatgaacatgtgtgtgtgtgtgtgtgtgtgtgtgtgtgtgtgtgtgtgtgtgtgcaatacgctatctatggttcataggaggtccaaagacaaggctcgcaggttttggtccctcttctccctccatgtgggtcctgtcagtggcccagggcatcaggcttggctgccagcagggtcttcacttgctgagctttgtcaccacctccttttttgtatataaacattttgttaccttttttgaaatgagaatttgaagcttccactgacttacacttttagcagcagtaaaggtaactcagtcccattccatgacgggtcagtgatctatagcaaccacagtgtaaagccgtaacttgcgcttttgagctgacagatttgggcccatcttgtaccctttgggaaaaaaaataaaaacactttgggtatgagcatgcctcttttctagtggtagattgtgtattaaagattgcttctagctttagtcttttatcttctgctgagagcttagacagctagaatattctacctagtcacagatagccaagatgaattaagggttaactttgtagtatttatttttaacattaactagtatttaaaagtgctagtgtgggctggagagatggctcactggttaagagcacttactgctcttccagaggtcccgagtccaattcccagcaaccatattgtggctcacaaccatctgtaatgggatctgatgccctcttctggtgtctgaagacggctacactgtactctcagacataaaacaaatcttaaagaaataatgtactagtgtactacagattttaagaagaaggtgtgcgtgtgggggtggggtgggggaggggtgctggagggtggctcattggttaaagtacttcctgcgcttgccttttcctcaaaccctccatttcttagctggaatagctccctgtttctctaggctctgtcttggctctaagactctgacttccttctttccctccaagctggccctgctgtcagcctattactcacaggtcagcagtcttccctcgtctccccactgcctctgaaggcctcatacttaatggaaatatgaaatatgacacattataggatttcttttcttaggtaaaaatgttactaaaaattagcctactataaattcatagcttatgagtaagggttactaagtaatgtttccttgacatgacattttttttagcagtgatgtgtaaataaagtccactccggcattgttaacacctgctattgggagcataggagtcagtgatgggactgaagactgtcggctgctgcatgctctacagatgtgtgtcagcatcacttacgtcctctctaggatggctttgaatgccgtggtctatctgctacaagaagcggtgtttcccagcagaacaataacacacattcgtagccaaggagtcctgtgatgctttgactgcttattcttgcactgtagctttcatggtgtgacctagtttatcagacagttcagtttaagagacacaaataggtaggggcgtttaagcgaaacactaactaatagttaagttaggggcttaacaatcttaggcattgttctgagccaggcttttgaaatatagaccaatttgtgagaagggctgccaccattgcctgattagggtggtggggtcagtggagagcgcccatgttcagttcccagaacgacccctatggctcataatcacccaagactcagaggattctgcactccattatcacccctgagggtatgtgcgagtgcacacccctgcacgtatgcatgcacgtgagcacacacacacacagagtctaaaacattagatcttttatataacatatttaattagtaaaacattttcttcaattttttatatgtatgggtgtttttcttgcatgtatgtatcagtctcacgtgcatgtagtgcctgaggagccagagaggatattagatccccctgggaccaggattgtagatggttttgtgctgccctataggtgctggaaattgagcccaggtcctttgaagaacagcctgtgccctcaactgctgaaccagctttccagtccctaactaaatcttatcaacaaacaaacgagcaaaaccccagaaattatgtatagctatgatatagttgtcaagactttctggttccactgaaatagctgtgaggcaggattcaaggctgaatctccatgactttgcttactaggaaaacagtgtgtctcactgactcatttatgctttttgtagctcatgtgggttcttagtctgcagccagagaccaggttttagctctgtactgctgtaagcctgaaggaagacatggtgggaggttctgagggactcattccctagcagcatcttcagggcttcacagtggttgggtcagggttggcagctgatttctgttctcattttgcataatgtaaggttataataaccccatgaatatgtacaatattaagtgaaaaattaaaggtaaattaaagggtaactctctgaagttgcattcacacatagaatccgcagagctcaggcctcccttcacatcacccttgtatagaggtttgtagcatcaggaagtcagtattttgcctcaaaggccaacaggaggaaagtggagtgcctacaatctgggttaactttattgctcgctcactttaaaaactcaagcctggggaggacaggcagggtgcccttgggaggggaggccggcagctcctggagttcaaggccatcctggctaccaacctggactagagaccgtttgaaaattgagaagaacaataggaaaaaagtatgctaactataacttagttttaaagttttggtccttttaaaatcacacaacttttaaatctgacttctatgtcatttatgggttttcttggtttttagctctcttgtgtgtttaaagcagaactagtgtgcagagctgcttgcccctcgcaatacactttacccagaggcgtctggaagtgttcttattatagcttggtattcagcatacattttctgaacacaaggatacattcctgcaatgtgttgttttgttttgtttgttgttgcttttgagatagggactgatatgttaccaaggctggtattccattcctgggctcagatttccttttcctttggccagttgggtgactgcaggcatgtgtcacaatgagcttcgctacttttgctttgagacagtgtcttagccagtgctcttgctgtaatgaggcataatgatctcggcaactcaaaaaggggagtatttaattggggctggattacagttcagagatttagtccactgtcacagcagggagcatggcgggatgcaggtagacatgggctggagaagtagctcagagtcctacatcggcatccatagacagagagactgggcctggcataggcatttgaaactttagagtccacccccagtgacacacttcctccagtaagatcacacctatatgaccctgtggggccattcatattcagactattacattctagtccctggtccccacaagcttgtagccatgtcatagtgcaaaatagtccaacttcaaaggtcaccatagtctcttggtcttaagactgcttcaaaatctaaagtgtcttctgagattcatggcaatctcttcactgtaatcccctgtaacatcaaatcacaggtcacaacatacagtggttctgaatatagtcatttctatgtctttaattcttcaagtctgtgatgaagctgctgtgtgacaaggcacagtttcaggtactgggacacaggtaagcagcatcaggttgagctctcattgcttacagaccagacagagtatcaagacagtatgtttgtgccgagaatgaaaatgaaatagtgagaaagccaggaggttgcttgaaacgggatagtcggagagggactccagggagaaacttagtaaatccaggcttgagtggcagcgagggagccagcccgggaaagcacattaaagtgagatagtttgtcttatcaaaggtgttttccagtggcttctaacagtgataaagatatataaaccaacactcatttgtgtaagaatcactactagtgaaccttgaacagaaagtgcaaatacctacctcttctctgataattcaaatgtgtaggttttttgaatcagaactttgacatttttatacttgtaattattaaactaatttctcaccttctgaggtattcaggcagtgaccattttgattcatggaacagcttatttcctacgtgattgcctgctctcctggcagatctcctatgcgttgttttaacagatattcacgtttgaatgtttcaggcaacagcagcagcagcaggaggtagaccgacctggacccctttcatatccacgtgaaagaccgaccacaagttcaggaggacgtaggagcgaccaaggtttgctttctgtccattcacagtgatgctttactcgatacccaagatcctcgtcaattgtactttatatttctcctcctcctcctctccttcctcctctttctcttccccctccttctttatattgggttttttatttgtttgtttctatctttttctttttttttcttttctttctttcttttttttttttgagacagggtttctctgtatagccttggctgtcctacaactcactctgtaaaccatacatagagtcataagagatctgcctgcctctgcctcccagcacagtgattaaagatgtgcaccaccacctggcttttccttttttaaaaatttatgaattttatgtattagtgctctgtctgtatgtatgcctgcatgccagctgagagcatcagatcccattataaatgttgctgggaattgaactcagaacctctggaagagcaacccatgcttctaaccactgagccatctctccagcccccttttcttctttaattgtattataaaactctttttgttttttggttttttgagacagggtttctctgtgtagccctcagctatcctggaactcactctgtagaccaggcgggcctcgaatacagaaatccatctgcctctgcttcccaagtgctgggattaaaggcgtgcaccaccacgcccagcttataaaactcttaaaaatgaatttgtaatataccaatttcctctgaactataagggagatagacacttggtagttgtttggattttatttatttaatgtagttttggttttgagacagtttcattatgtagctagggctagcttggaactcactgtgtagcccagactagcttcaaattcatgagtcttcggtttgggcttttttagaagtaacaggaacaggcatgcaccaccatgccctggttggttctaaaatcgcacacatagtactttaacttcacagttgacacattcctgagaaatccttcagagatgattagaggtaataaataatagtaagtggaaaggaaacacatttcaccacttagtaaaggaaaccatctcgttagcatagtctagataacagctggaggccaggtgactactcacccatcctccagacagcagctgttaagctcgagtcaagtattggtagaagctgaatggagaagaagccctgtctgtcagaggacttcatagaatctatgcagagctctcagagtgacacaaaaacagtaaaaaaaaactgatgaaggggtgctggagagatggctcagcagttaagagtgctgactgctcttccagaggcccagagttcaaatcccagcaaccacatggtggctcacaatcatctataatgggatccaatgccctcttctgatatgttcaaagacatcattgatgtactcacatacataaaataaataaatagataaatcttaaaaaaacaaaaaaaagactggtgaaggattgtggatgtgagatgtgtcttgcactagagagcacattacacagaatcctataatgcagctgcaggtggctttgacacctctgtcctacttgggcacctgcggtcaatgtgcatatatcctacacagatgcctgtatcagaggaggctcaccgaaaggaagatttcattaaaactcacaaggtgacaaaacccaagtacccagggttcacttggaaacaaaccactgttattccaggaaccatgaaagaaggaaccacgtggacaattttaattgagcattgctttttggttttttgttttgttttgttctgtttcgaggcagtctcactctgtagcccagcctggctgtgaattcactattgtcccacgtctgcctctggagtgctgagactctggtcacccgcagccacctgcatctcacacattttagagcagaagagtaactgaaatgtaaaagctcagtgaatggacttagcatagaaagctggtagactagatgacaggcatgtagaaatccttcccatcaacacggcaaactgactgtagccaatgagcagagcgctggaggcatctgacattattagctcagcctaactcacaggagcctcctaactggaagcagaaggggtggtgaaaacatctgatgatcttttcatcgtctcagctgaacagaaactagaagcctgcaagtggaagaaattgagtgaacttcaaatttatgtaaacgaaaagaaatacttactaggacttctgaaaactgaaggcataatcaaaagaaagaactaatcaaagaaagaactgttcttcaaagaacagcaatttgaagtgggaggtgtctatgagtgacagtggataatgtggttcccatgctgaaagaaacctttaatccaggactacatatgctggacttacatacttactaggattgggaaagagtttcaaaaatgtctccagcagttaaagaaagggatggctgttcagggctggcaatcagatcagcatctcgattagccaccatcagagatgcttgtacttgcagtggatgggaacaaatgagtaactggcttggaatacactaaacaggatgtgtcatcaaaccctgcccttcaggcttcagggaactttgagggaaaggtagcagaaagatggtcagagctggtgggggcggaagacaccaggaagcagcgccttcccgacacagcagagctgatgcgcggatgaactcacaaatggtggcagggtgctcaggtcaagccttgtggtgtctcgcagctaagaggggggagtgagtgaacgccatctcccatacctaactcagaagctatctctagttgccaaacctgacaatcttaatctaaccatcagaacccacgtgatggaagcgggcactaactctgtctgtacatgtcatggcacactatgcccacagagttacacacagttaacaaagtctttgtggggaaaaaaaaaacaaactagtattcaagtagaaatatgtttgctaagaatttgctttttcttttttcctttatcttggacaggtttcaagtagcttgggctggcttcaaatgttttatatatatagtcaaggacaaccttgagttctgattctcctgcctctgtttcctaagagctgggattacaggagtgtgcctccatttcccgtgttatgccatgctagggattgagcccagagccttgcgcatactaggcaaacgttctaccaacttagctatagctctattcagaagtttgccagtgatggggatcttgcagaagttgttctgagaactctgttttctttcccaggaggcgacgctgtgagtgaagaggacatgcttcgggcagctgtgaccatgtctttagaaactgctaaagacaacttgaaagcagaaagaaaaaaatagtacctttaaaagtcattttgctactcacactttgtaacattgtctgtgtgattacagtgtaagggccactttggcagtatgttcaccagaagagataaagacactgtagtggtttgtaagcagaaaggcagaaatgtgtcataggactaaggaacgatcgagatactagccaaagaggcagtcagcaatgaaagaaacttttctaaatgtcccgttttgtttttcaaatgtgcaatatctgactgaaattatggaatttttgttggctcttttggaccaactgattagctcttgccacagaacttgatcctataatgtttcgttttctctctgcattgggggtggcttggctcacttgagcttttacttcatttcagacctaccttttatgaaatgtcttttatatgtcttgttacagaaagatcagtctgtcttctcatacatatgtcgggcacgtggatgcttcctggtggtattttctctaatgtggtgatgtgttgcttttaaagcctttgttagtgggatcacatttcctaattgtgctgcattcctctactctgcagtcagctctgttcttgtaactgagcacgtgagcgtgctctgtctggatgccctgagagtggctgactcctggctggagcccttcctgtaccttccttcctctcttctccagctgagaaaagaggaggcagaggacacaaacagatttccttctacgtaacatgcaccatgaatgcaccacaggagaaactcgcccttcagtcctggtggtgggtttgtcctagtttttcatctgtgacaggagctttgtgttctaatcacgattaagtcctggaaaatagatgcctgcttcactttctaaaaattaaaaatatttttttttctttttctagtagaaaataggctgctaggatgatggtctagaatctgaaagtaatttactaataaaatatatttaaataatactgtgggttgacccttgcaatcatgtttaaatcgcttaagaattacagaagtcacaaagcttaaagggtctgtttgtaaataggaaagtccttagttttgataaacattaagcaggatgcagagctagtcttgctgggtcaatacgtggtatgatttgggtggaaattaactctgtgtctttgtcatggtgtcatagataccctgatacctgctttcccctccctcccctttgaagcccctttgaatggtgacttgtacataggtaaagtccaagaagagattgtagccagcttaggaaggggcagcatgctatagtgctctactggtgtgtgctctgcacacgtttttatcagggaaagttttggatgtaggatttattgctgtctaactgaaaaagatacaaatatttttatttatgcttatgaaatagctttttcttgataggatggatgtttggtttggtttggttgtgcgagggattgaacccagggcctccagtgtgctaggcaagcgccctacctctgagctatatccccagatccagaacaggggtttccttgtttgctttttgttgtttttcttagccattttgtgccaactacagttgttttttaaaaatttgcttcatgaaaaattaggcagtcctattttaaaatctatgaagttttctttcagtaattgcaaaggttcagaagagttgggcagctgtagggtgttagagttaggactttgcttacagttgattgctatactgaagtatgtaactactcccgtatgctgctcacatgtctagacattcattggcccttttcctttaccctttgaaaaatcacattaaactttccatacatttagattggtgtgctgcctgatgaaaaatgagaaagccaatatacacttcagctttaactttagagtttataaaatgttcatataacacaccctacttaaatcatgtatgaaatacagcatgttagtcttttattagaaatgttttaaagagaaactgagcacacactgaatctatttgagtgaagctttttagtttgttatatttatggcattgtccaggcagatccaaaatcaccattgaattgccatcctctttgggttgacctaggcttactaaacatttagatttcattattaatgagtagccagtatgaaaagatgccaatgcttattctagccacagtatccaaagtgtaggagttctatgacattctaattcataaccaggagttgctgtttatagtactgcaggacagacaggggcaagggactccactgccacggctggtcacagactcgactaacttttccatttgtttttttaccaattggaatacttaaatgtattgtatgtaatgaatactaaactactgataatcattttttttaaatctgtaacttgttctgccagataaaatgcgtacagccgtgatgctagtgttataaccaagtgtaaggaccctttggaaggccagacatggtgctgtgttcctttgatgctggtacttaggagaaatctgcagaggtaggcagatttcttcttgagttcaaggccagcctggtctacatagtaagttccagactttctggagctgcacagtaagaccctgtcttaaacaaaaaacaaacaaaccaacctttggaaagatcactttcatattttgggatgtcatgagcttatctatgtttcaaaattcagaatagctgtcctttggcctaaaccataaatctacacccccaacgacagtactatgcagacatttcactgatttaagttgtttgatacagtcagtgcaggtgaactccatgctaaagttttaagccttggccaaataacttacacctcacagactgtctgaggcggtgcttctttttttcctgaaaacttgatttttcttgatgaagccaaagttaatgagcatgaattctcaaaggagtagtctgctttgttttacttaatatcaggttgagtgaagtaagttttattcgtgtcagagtctaagccacacattttgaatacccacatgtttgatactatttaagtcatgctgtgccaagagttactaaattcttagaactggccctgtgccctgcctaaggccagacagggcagtgcggaacccaaatgtgctatctgagagtcttaagctaggaaatctgggtgttttaaattagtgagaggtttcagttagtgttgaaacctccagatccgacttgatgttaggcagtgtggatgtgctcagtggtagagcagttacctagtggcccaggccttgggttcagtctctaacactgcaaaaggagagcagtggctcacagtgtaacctacgtttagagagacatgaaaggaagtactttcaaagtgaatgtttgttgtaatttagtcctaacaagtgtagagctatgatatgtgaccttaattaagaaaaaccagattggatcagtagtatttttgttgtttttcatatttaacataaaaattcccttcatccctaatttgtttataattaaagagacaaattgattttgtattttttcaaagttttatacatattaaaagggttttgttgtagtctatcatgaatgaaaaggatatttttttttttaatttgaggaatacttttgtgtgtgtgtgcctaaaatggtctgtcattttaagaattagcacaaaaaaaaaattagctagttcctaaatgtatggaggtttaatagtaccagtacacagttgtgggtgaggcactagtgagaagtgtgtgggaaatgcagctgggtaggtgggactcacttgtctctgaatggtttaaaggtggtatttcctggaatttttttaatgattttttttttcaaggaagacagacattcgaaatgtgcttatcaaatttctacaacactggactaataggaataactttttttttaaaaaaaaaagactgttctgtataaataaaatatatgaaactcaagtgcaaaagccgtgaaaataaaaggcattgtcttctgtcaatgtgatgcactgtggccgagcagttccctcaggactcaactctgcagcccttcctcctgtgcctcaagtgtcggctgccactccacaggtcttccgtctgtcggctcctttgaaagccgggcttccaaagccctgttgaacactgagggttctggtgatgtgtgttaatgagttgtattttaaatatcagagattattaaataaagagaatgattttctattaa

SEQ ID NO: 4 - DNA, 14 bp, Artificial sequence
  Synthetic oligonucleotide
aagaaaccaaaccc

SEQ ID NO: 5 - DNA, 14 bp, Artificial sequence
  Synthetic oligonucleotide
aaagaaaccaaacc

SEQ ID NO: 6 - DNA, 14 bp, Artificial sequence
  Synthetic oligonucleotide
aaaagaaaccaaac

SEQ ID NO: 7 - DNA, 14 bp, Artificial sequence
  Synthetic oligonucleotide
caaaagaaaccaaa

SEQ ID NO: 8 - DNA, 14 bp, Artificial sequence
  Synthetic oligonucleotide
ccaaaagaaaccaa

SEQ ID NO: 9 - DNA, 14 bp, Artificial sequence
  Synthetic oligonucleotide
tccactcctaatac

SEQ ID NO: 10 - DNA, 14 bp, Artificial sequence
  Synthetic oligonucleotide
gtccactcctaata

SEQ ID NO: 11 - DNA, 14 bp, Artificial sequence
  Synthetic oligonucleotide
agtccactcctaat

SEQ ID NO: 12 - DNA, 14 bp, Artificial sequence
  Synthetic oligonucleotide
cagtccactcctaa

SEQ ID NO: 13 - DNA, 14 bp, Artificial sequence
  Synthetic oligonucleotide
ccagtccactccta

SEQ ID NO: 14 - DNA, 14 bp, Artificial sequence
  Synthetic oligonucleotide
actctttccaaaca

SEQ ID NO: 15 - DNA, 14 bp, Artificial sequence
  Synthetic oligonucleotide
aactctttccaaac

SEQ ID NO: 16 - DNA, 14 bp, Artificial sequence
  Synthetic oligonucleotide
caactctttccaaa

SEQ ID NO: 17 - DNA, 14 bp, Artificial sequence
  Synthetic oligonucleotide
gcaactctttccaa

SEQ ID NO: 18 - DNA, 14 bp, Artificial sequence
  Synthetic oligonucleotide
agcaactctttcca

SEQ ID NO: 19 - DNA, 14 bp, Artificial sequence
  Synthetic oligonucleotide
cagcaactctttcc

SEQ ID NO: 20 - DNA, 14 bp, Artificial sequence
  Synthetic oligonucleotide
ccagcaactctttc

SEQ ID NO: 21 - DNA, 14 bp, Artificial sequence
  Synthetic oligonucleotide
accagcaactcttt

SEQ ID NO: 22 - DNA, 14 bp, Artificial sequence
  Synthetic oligonucleotide
ctcctattaaataa

SEQ ID NO: 23 - DNA, 14 bp, Artificial sequence
  Synthetic oligonucleotide
cctcctattaaata

SEQ ID NO: 24 - DNA, 14 bp, Artificial sequence
  Synthetic oligonucleotide
tcctcctattaaat

SEQ ID NO: 25 - DNA, 14 bp, Artificial sequence
  Synthetic oligonucleotide
ctcctcctattaaa

SEQ ID NO: 26 - DNA, 14 bp, Artificial sequence
  Synthetic oligonucleotide
gctcctcctattaa

SEQ ID NO: 27 - DNA, 14 bp, Artificial sequence
  Synthetic oligonucleotide
tgctcctcctatta

SEQ ID NO: 28 - DNA, 14 bp, Artificial sequence
  Synthetic oligonucleotide
ttgctcctcctatt

SEQ ID NO: 29 - DNA, 14 bp, Artificial sequence
  Synthetic oligonucleotide
tttgctcctcctat

SEQ ID NO: 30 - DNA, 14 bp, Artificial sequence
  Synthetic oligonucleotide
ctttgctcctccta

SEQ ID NO: 31 - DNA, 14 bp, Artificial sequence
  Synthetic oligonucleotide
cctttgctcctcct

SEQ ID NO: 32 - DNA, 14 bp, Artificial sequence
  Synthetic oligonucleotide
ccctttgctcctcc

SEQ ID NO: 33 - DNA, 14 bp, Artificial sequence
  Synthetic oligonucleotide
accctttgctcctc

SEQ ID NO: 34 - DNA, 14 bp, Artificial sequence
  Synthetic oligonucleotide
aaccctttgctcct

SEQ ID NO: 35 - DNA, 14 bp, Artificial sequence
  Synthetic oligonucleotide
aaaccctttgctcc

SEQ ID NO: 36 - DNA, 14 bp, Artificial sequence
  Synthetic oligonucleotide
aaaaccctttgctc

SEQ ID NO: 37 - DNA, 14 bp, Artificial sequence
  Synthetic oligonucleotide
aaaaaccctttgct

SEQ ID NO: 38 - DNA, 14 bp, Artificial sequence
  Synthetic oligonucleotide
caaaaaccctttgc

SEQ ID NO: 39 - DNA, 14 bp, Artificial sequence
  Synthetic oligonucleotide
acaaaaaccctttg

SEQ ID NO: 40 - DNA, 14 bp, Artificial sequence
  Synthetic oligonucleotide
aacaaaaacccttt

SEQ ID NO: 41 - DNA, 14 bp, Artificial sequence
  Synthetic oligonucleotide
aaacaaaaaccctt

SEQ ID NO: 42 - DNA, 14 bp, Artificial sequence
  Synthetic oligonucleotide
aaaacaaaaaccct

SEQ ID NO: 43 - DNA, 14 bp, Artificial sequence
  Synthetic oligonucleotide
taaaacaaaaaccc

SEQ ID NO: 44 - DNA, 14 bp, Artificial sequence
  Synthetic oligonucleotide
ataaaacaaaaacc

SEQ ID NO: 45 - DNA, 14 bp, Artificial sequence
  Synthetic oligonucleotide
aataaaacaaaaac

SEQ ID NO: 46 - DNA, 14 bp, Artificial sequence
  Synthetic oligonucleotide
taataaaacaaaaa

SEQ ID NO: 47 - DNA, 14 bp, Artificial sequence
  Synthetic oligonucleotide
ttaataaaacaaaa

SEQ ID NO: 48 - DNA, 14 bp, Artificial sequence
  Synthetic oligonucleotide
tttaataaaacaaa

SEQ ID NO: 49 - DNA, 14 bp, Artificial sequence
  Synthetic oligonucleotide
atttaataaaacaa

SEQ ID NO: 50 - DNA, 14 bp, Artificial sequence
  Synthetic oligonucleotide
ttaaaataaaaatt

SEQ ID NO: 51 - DNA, 14 bp, Artificial sequence
  Synthetic oligonucleotide
tttaaaataaaaat

SEQ ID NO: 52 - DNA, 14 bp, Artificial sequence
  Synthetic oligonucleotide
ctttaaaataaaaa

SEQ ID NO: 53 - DNA, 14 bp, Artificial sequence
  Synthetic oligonucleotide
tctttaaaataaaa

SEQ ID NO: 54 - DNA, 14 bp, Artificial sequence
  Synthetic oligonucleotide
atctttaaaataaa

SEQ ID NO: 55 - DNA, 14 bp, Artificial sequence
  Synthetic oligonucleotide
catctttaaaataa

SEQ ID NO: 56 - DNA, 14 bp, Artificial sequence
  Synthetic oligonucleotide
ccatctttaaaata

SEQ ID NO: 57 - DNA, 14 bp, Artificial sequence
  Synthetic oligonucleotide
tctaacttaataaa

SEQ ID NO: 58 - DNA, 14 bp, Artificial sequence
  Synthetic oligonucleotide
ttctaacttaataa

SEQ ID NO: 59 - DNA, 14 bp, Artificial sequence
  Synthetic oligonucleotide
attctaacttaata

SEQ ID NO: 60 - DNA, 14 bp, Artificial sequence
  Synthetic oligonucleotide
cattctaacttaat

SEQ ID NO: 61 - DNA, 14 bp, Artificial sequence
  Synthetic oligonucleotide
acattctaacttaa

SEQ ID NO: 62 - DNA, 14 bp, Artificial sequence
  Synthetic oligonucleotide
tacattctaactta

SEQ ID NO: 63 - DNA, 14 bp, Artificial sequence
  Synthetic oligonucleotide
ttacattctaactt

SEQ ID NO: 64 - DNA, 14 bp, Artificial sequence
  Synthetic oligonucleotide
tttacattctaact

SEQ ID NO: 65 - DNA, 14 bp, Artificial sequence
  Synthetic oligonucleotide
ttttacattctaac

SEQ ID NO: 66 - DNA, 14 bp, Artificial sequence
  Synthetic oligonucleotide
tttttacattctaa

SEQ ID NO: 67 - DNA, 14 bp, Artificial sequence
  Synthetic oligonucleotide
gtttttacattcta

SEQ ID NO: 68 - DNA, 14 bp, Artificial sequence
  Synthetic oligonucleotide
tgtttttacattct

SEQ ID NO: 69 - DNA, 14 bp, Artificial sequence
  Synthetic oligonucleotide
ctgtttttacattc

SEQ ID NO: 70 - DNA, 14 bp, Artificial sequence
  Synthetic oligonucleotide
ttcaaatatttatt

SEQ ID NO: 71 - DNA, 14 bp, Artificial sequence
  Synthetic oligonucleotide
attcaaatatttat

SEQ ID NO: 72 - DNA, 14 bp, Artificial sequence
  Synthetic oligonucleotide
cattcaaatattta

SEQ ID NO: 73 - DNA, 14 bp, Artificial sequence
  Synthetic oligonucleotide
ccattcaaatattt

SEQ ID NO: 74 - DNA, 14 bp, Artificial sequence
  Synthetic oligonucleotide
cccattcaaatatt

SEQ ID NO: 75 - DNA, 14 bp, Artificial sequence
  Synthetic oligonucleotide
ccccattcaaatat

SEQ ID NO: 76 - DNA, 14 bp, Artificial sequence
  Synthetic oligonucleotide
gccccattcaaata

SEQ ID NO: 77 - DNA, 14 bp, Artificial sequence
  Synthetic oligonucleotide
tatacatttttttc

SEQ ID NO: 78 - DNA, 14 bp, Artificial sequence
  Synthetic oligonucleotide
atatacattttttt

SEQ ID NO: 79 - DNA, 14 bp, Artificial sequence
  Synthetic oligonucleotide
tatatacatttttt

SEQ ID NO: 80 - DNA, 14 bp, Artificial sequence
  Synthetic oligonucleotide
atatatacattttt

SEQ ID NO: 81 - DNA, 14 bp, Artificial sequence
  Synthetic oligonucleotide
aatatatacatttt

SEQ ID NO: 82 - DNA, 14 bp, Artificial sequence
  Synthetic oligonucleotide
aaatatatacattt

SEQ ID NO: 83 - DNA, 14 bp, Artificial sequence
  Synthetic oligonucleotide
caaatatatacatt

SEQ ID NO: 84 - DNA, 14 bp, Artificial sequence
  Synthetic oligonucleotide
tcaaatatatacat

SEQ ID NO: 85 - DNA, 14 bp, Artificial sequence
  Synthetic oligonucleotide
ttcaaatatataca

SEQ ID NO: 86 - DNA, 14 bp, Artificial sequence
  Synthetic oligonucleotide
attcaaatatatac

SEQ ID NO: 87 - DNA, 14 bp, Artificial sequence
  Synthetic oligonucleotide
cattcaaatatata

SEQ ID NO: 88 - DNA, 14 bp, Artificial sequence
  Synthetic oligonucleotide
ccattcaaatatat

SEQ ID NO: 89 - DNA, 14 bp, Artificial sequence
  Synthetic oligonucleotide
tccattcaaatata

SEQ ID NO: 90 - DNA, 14 bp, Artificial sequence
  Synthetic oligonucleotide
atccattcaaatat

SEQ ID NO: 91 - DNA, 14 bp, Artificial sequence
  Synthetic oligonucleotide
tatccattcaaata

SEQ ID NO: 92 - DNA, 14 bp, Artificial sequence
  Synthetic oligonucleotide
ttatccattcaaat

SEQ ID NO: 93 - DNA, 14 bp, Artificial sequence
  Synthetic oligonucleotide
tttatccattcaaa

SEQ ID NO: 94 - DNA, 14 bp, Artificial sequence
  Synthetic oligonucleotide
ctttatccattcaa

SEQ ID NO: 95 - DNA, 14 bp, Artificial sequence
  Synthetic oligonucleotide
tctttatccattca

SEQ ID NO: 96 - DNA, 14 bp, Artificial sequence
  Synthetic oligonucleotide
ctctttatccattc

SEQ ID NO: 97 - DNA, 14 bp, Artificial sequence
  Synthetic oligonucleotide
tctctttatccatt

SEQ ID NO: 98 - DNA, 14 bp, Artificial sequence
  Synthetic oligonucleotide
ccatatatatctca

SEQ ID NO: 99 - DNA, 14 bp, Artificial sequence
  Synthetic oligonucleotide
accatatatatctc

SEQ ID NO: 100 - DNA, 14 bp, Artificial sequence
  Synthetic oligonucleotide
caccatatatatct

SEQ ID NO: 101 - DNA, 14 bp, Artificial sequence
  Synthetic oligonucleotide
gcaccatatatatc

SEQ ID NO: 102 - DNA, 14 bp, Artificial sequence
  Synthetic oligonucleotide
agcaccatatatat

SEQ ID NO: 103 - DNA, 14 bp, Artificial sequence
  Synthetic oligonucleotide
cagcaccatatata

SEQ ID NO: 104 - DNA, 14 bp, Artificial sequence
  Synthetic oligonucleotide
acagcaccatatat

SEQ ID NO: 105 - DNA, 14 bp, Artificial sequence
  Synthetic oligonucleotide
aacagcaccatata

SEQ ID NO: 106 - DNA, 14 bp, Artificial sequence
  Synthetic oligonucleotide
aaaacaaacaacaa

SEQ ID NO: 107 - DNA, 14 bp, Artificial sequence
  Synthetic oligonucleotide
taaaacaaacaaca

SEQ ID NO: 108 - DNA, 14 bp, Artificial sequence
  Synthetic oligonucleotide
ctaaaacaaacaac

SEQ ID NO: 109 - DNA, 14 bp, Artificial sequence
  Synthetic oligonucleotide
actaaaacaaacaa

SEQ ID NO: 110 - DNA, 14 bp, Artificial sequence
  Synthetic oligonucleotide
aactaaaacaaaca

SEQ ID NO: 111 - DNA, 14 bp, Artificial sequence
  Synthetic oligonucleotide
gaactaaaacaaac

SEQ ID NO: 112 - DNA, 14 bp, Artificial sequence
  Synthetic oligonucleotide
agaactaaaacaaa

SEQ ID NO: 113 - DNA, 14 bp, Artificial sequence
  Synthetic oligonucleotide
cagaactaaaacaa

SEQ ID NO: 114 - DNA, 14 bp, Artificial sequence
  Synthetic oligonucleotide
ccagaactaaaaca

SEQ ID NO: 115 - DNA, 14 bp, Artificial sequence
  Synthetic oligonucleotide
accagaactaaaac

SEQ ID NO: 116 - DNA, 14 bp, Artificial sequence
  Synthetic oligonucleotide
atgttattatcccc

SEQ ID NO: 117 - DNA, 14 bp, Artificial sequence
  Synthetic oligonucleotide
tatgttattatccc

SEQ ID NO: 118 - DNA, 14 bp, Artificial sequence
  Synthetic oligonucleotide
ctatgttattatcc

SEQ ID NO: 119 - DNA, 14 bp, Artificial sequence
  Synthetic oligonucleotide
tctatgttattatc

SEQ ID NO: 120 - DNA, 14 bp, Artificial sequence
  Synthetic oligonucleotide
tacactctaactct

SEQ ID NO: 121 - DNA, 14 bp, Artificial sequence
  Synthetic oligonucleotide
ctacactctaactc

SEQ ID NO: 122 - DNA, 14 bp, Artificial sequence
  Synthetic oligonucleotide
tctacactctaact

SEQ ID NO: 123 - DNA, 14 bp, Artificial sequence
  Synthetic oligonucleotide
ctctacactctaac

SEQ ID NO: 124 - DNA, 14 bp, Artificial sequence
  Synthetic oligonucleotide
tctctacactctaa

SEQ ID NO: 125 - DNA, 14 bp, Artificial sequence
  Synthetic oligonucleotide
ttctctacactcta

SEQ ID NO: 126 - DNA, 14 bp, Artificial sequence
  Synthetic oligonucleotide
cttctctacactct

SEQ ID NO: 127 - DNA, 14 bp, Artificial sequence
  Synthetic oligonucleotide
ccttctctacactc

SEQ ID NO: 128 - DNA, 14 bp, Artificial sequence
  Synthetic oligonucleotide
tacaacacaaatca

SEQ ID NO: 129 - DNA, 14 bp, Artificial sequence
  Synthetic oligonucleotide
ctacaacacaaatc

SEQ ID NO: 130 - DNA, 14 bp, Artificial sequence
  Synthetic oligonucleotide
actacaacacaaat

SEQ ID NO: 131 - DNA, 14 bp, Artificial sequence
  Synthetic oligonucleotide
aactacaacacaaa

SEQ ID NO: 132 - DNA, 14 bp, Artificial sequence
  Synthetic oligonucleotide
taactacaacacaa

SEQ ID NO: 133 - DNA, 14 bp, Artificial sequence
  Synthetic oligonucleotide
ctaactacaacaca

SEQ ID NO: 134 - DNA, 14 bp, Artificial sequence
  Synthetic oligonucleotide
actaactacaacac

SEQ ID NO: 135 - DNA, 14 bp, Artificial sequence
  Synthetic oligonucleotide
tactaactacaaca

SEQ ID NO: 136 - DNA, 14 bp, Artificial sequence
  Synthetic oligonucleotide
ctactaactacaac

SEQ ID NO: 137 - DNA, 14 bp, Artificial sequence
  Synthetic oligonucleotide
actactaactacaa

SEQ ID NO: 138 - DNA, 14 bp, Artificial sequence
  Synthetic oligonucleotide
cactactaactaca

SEQ ID NO: 139 - DNA, 14 bp, Artificial sequence
  Synthetic oligonucleotide
acactactaactac

SEQ ID NO: 140 - DNA, 14 bp, Artificial sequence
  Synthetic oligonucleotide
gacactactaacta

SEQ ID NO: 141 - DNA, 14 bp, Artificial sequence
  Synthetic oligonucleotide
agacactactaact

SEQ ID NO: 142 - DNA, 14 bp, Artificial sequence
  Synthetic oligonucleotide
tttacccccaacct

SEQ ID NO: 143 - DNA, 14 bp, Artificial sequence
  Synthetic oligonucleotide
atttacccccaacc

SEQ ID NO: 144 - DNA, 14 bp, Artificial sequence
  Synthetic oligonucleotide
catttacccccaac

SEQ ID NO: 145 - DNA, 14 bp, Artificial sequence
  Synthetic oligonucleotide
tcatttacccccaa

SEQ ID NO: 146 - DNA, 14 bp, Artificial sequence
  Synthetic oligonucleotide
atcatttaccccca

SEQ ID NO: 147 - DNA, 14 bp, Artificial sequence
  Synthetic oligonucleotide
aatcatttaccccc

SEQ ID NO: 148 - DNA, 14 bp, Artificial sequence
  Synthetic oligonucleotide
aaatcatttacccc

SEQ ID NO: 149 - DNA, 14 bp, Artificial sequence
  Synthetic oligonucleotide
caaatcatttaccc

SEQ ID NO: 150 - DNA, 14 bp, Artificial sequence
  Synthetic oligonucleotide
ccaaatcatttacc

SEQ ID NO: 151 - DNA, 14 bp, Artificial sequence
  Synthetic oligonucleotide
accaaatcatttac

SEQ ID NO: 152 - DNA, 14 bp, Artificial sequence
  Synthetic oligonucleotide
taccaaatcattta

SEQ ID NO: 153 - DNA, 14 bp, Artificial sequence
  Synthetic oligonucleotide
ctaccaaatcattt

SEQ ID NO: 154 - DNA, 14 bp, Artificial sequence
  Synthetic oligonucleotide
gctaccaaatcatt

SEQ ID NO: 155 - DNA, 14 bp, Artificial sequence
  Synthetic oligonucleotide
tgctaccaaatcat

SEQ ID NO: 156 - DNA, 14 bp, Artificial sequence
  Synthetic oligonucleotide
ctgctaccaaatca

SEQ ID NO: 157 - DNA, 14 bp, Artificial sequence
  Synthetic oligonucleotide
actgctaccaaatc

SEQ ID NO: 158 - DNA, 14 bp, Artificial sequence
  Synthetic oligonucleotide
aactgctaccaaat

SEQ ID NO: 159 - DNA, 14 bp, Artificial sequence
  Synthetic oligonucleotide
aagctttaatcaaa

SEQ ID NO: 160 - DNA, 14 bp, Artificial sequence
  Synthetic oligonucleotide
caagctttaatcaa

SEQ ID NO: 161 - DNA, 14 bp, Artificial sequence
  Synthetic oligonucleotide
tcaagctttaatca

SEQ ID NO: 162 - DNA, 14 bp, Artificial sequence
  Synthetic oligonucleotide
atcaagctttaatc

SEQ ID NO: 163 - DNA, 14 bp, Artificial sequence
  Synthetic oligonucleotide
catcaagctttaat

SEQ ID NO: 164 - DNA, 14 bp, Artificial sequence
  Synthetic oligonucleotide
tcaaactatcccca

SEQ ID NO: 165 - DNA, 14 bp, Artificial sequence
  Synthetic oligonucleotide
ctcaaactatcccc

SEQ ID NO: 166 - DNA, 14 bp, Artificial sequence
  Synthetic oligonucleotide
tctcaaactatccc

SEQ ID NO: 167 - DNA, 14 bp, Artificial sequence
  Synthetic oligonucleotide
atctcaaactatcc

SEQ ID NO: 168 - DNA, 14 bp, Artificial sequence
  Synthetic oligonucleotide
tatctcaaactatc

SEQ ID NO: 169 - DNA, 14 bp, Artificial sequence
  Synthetic oligonucleotide
ttatctcaaactat

SEQ ID NO: 170 - DNA, 14 bp, Artificial sequence
  Synthetic oligonucleotide
cttatctcaaacta

SEQ ID NO: 171 - DNA, 14 bp, Artificial sequence
  Synthetic oligonucleotide
ccttatctcaaact

SEQ ID NO: 172 - DNA, 14 bp, Artificial sequence
  Synthetic oligonucleotide
cccttatctcaaac

SEQ ID NO: 173 - DNA, 14 bp, Artificial sequence
  Synthetic oligonucleotide
gcccttatctcaaa

SEQ ID NO: 174 - DNA, 14 bp, Artificial sequence
  Synthetic oligonucleotide
tgcccttatctcaa

SEQ ID NO: 175 - DNA, 14 bp, Artificial sequence
  Synthetic oligonucleotide
caaacttcatcaaa

SEQ ID NO: 176 - DNA, 14 bp, Artificial sequence
  Synthetic oligonucleotide
tcaaacttcatcaa

SEQ ID NO: 177 - DNA, 14 bp, Artificial sequence
  Synthetic oligonucleotide
atcaaacttcatca

SEQ ID NO: 178 - DNA, 14 bp, Artificial sequence
  Synthetic oligonucleotide
aatcaaacttcatc

SEQ ID NO: 179 - DNA, 14 bp, Artificial sequence
  Synthetic oligonucleotide
aaatcaaacttcat

SEQ ID NO: 180 - DNA, 14 bp, Artificial sequence
  Synthetic oligonucleotide
gaaatcaaacttca

SEQ ID NO: 181 - DNA, 14 bp, Artificial sequence
  Synthetic oligonucleotide
tgaaatcaaacttc

SEQ ID NO: 182 - DNA, 14 bp, Artificial sequence
  Synthetic oligonucleotide
ttgaaatcaaactt

SEQ ID NO: 183 - DNA, 14 bp, Artificial sequence
  Synthetic oligonucleotide
aacacaaatttcct

SEQ ID NO: 184 - DNA, 14 bp, Artificial sequence
  Synthetic oligonucleotide
taacacaaatttcc

SEQ ID NO: 185 - DNA, 14 bp, Artificial sequence
  Synthetic oligonucleotide
ctaacacaaatttc

SEQ ID NO: 186 - DNA, 14 bp, Artificial sequence
  Synthetic oligonucleotide
gctaacacaaattt

SEQ ID NO: 187 - DNA, 14 bp, Artificial sequence
  Synthetic oligonucleotide
tgctaacacaaatt

SEQ ID NO: 188 - DNA, 14 bp, Artificial sequence
  Synthetic oligonucleotide
ttgctaacacaaat

SEQ ID NO: 189 - DNA, 14 bp, Artificial sequence
  Synthetic oligonucleotide
tttgctaacacaaa

SEQ ID NO: 190 - DNA, 14 bp, Artificial sequence
  Synthetic oligonucleotide
ctttgctaacacaa

SEQ ID NO: 191 - DNA, 14 bp, Artificial sequence
  Synthetic oligonucleotide
cctttgctaacaca

SEQ ID NO: 192 - DNA, 14 bp, Artificial sequence
  Synthetic oligonucleotide
taactaataattat

SEQ ID NO: 193 - DNA, 14 bp, Artificial sequence
  Synthetic oligonucleotide
ataactaataatta

SEQ ID NO: 194 - DNA, 14 bp, Artificial sequence
  Synthetic oligonucleotide
aataactaataatt

SEQ ID NO: 195 - DNA, 14 bp, Artificial sequence
  Synthetic oligonucleotide
taataactaataat

SEQ ID NO: 196 - DNA, 14 bp, Artificial sequence
  Synthetic oligonucleotide
ataataactaataa

SEQ ID NO: 197 - DNA, 14 bp, Artificial sequence
  Synthetic oligonucleotide
aataataactaata

SEQ ID NO: 198 - DNA, 14 bp, Artificial sequence
  Synthetic oligonucleotide
caataataactaat

SEQ ID NO: 199 - DNA, 14 bp, Artificial sequence
  Synthetic oligonucleotide
ccaataataactaa

SEQ ID NO: 200 - DNA, 14 bp, Artificial sequence
  Synthetic oligonucleotide
accaataataacta

SEQ ID NO: 201 - DNA, 14 bp, Artificial sequence
  Synthetic oligonucleotide
aaccaataataact

SEQ ID NO: 202 - DNA, 14 bp, Artificial sequence
  Synthetic oligonucleotide
taaccaataataac

SEQ ID NO: 203 - DNA, 14 bp, Artificial sequence
  Synthetic oligonucleotide
ataaccaataataa

SEQ ID NO: 204 - DNA, 14 bp, Artificial sequence
  Synthetic oligonucleotide
tataaccaataata

SEQ ID NO: 205 - DNA, 14 bp, Artificial sequence
  Synthetic oligonucleotide
gtataaccaataat

SEQ ID NO: 206 - DNA, 14 bp, Artificial sequence
  Synthetic oligonucleotide
acatcacacaattt

SEQ ID NO: 207 - DNA, 14 bp, Artificial sequence
  Synthetic oligonucleotide
gacatcacacaatt

SEQ ID NO: 208 - DNA, 14 bp, Artificial sequence
  Synthetic oligonucleotide
tgacatcacacaat

SEQ ID NO: 209 - DNA, 14 bp, Artificial sequence
  Synthetic oligonucleotide
ctgacatcacacaa

SEQ ID NO: 210 - DNA, 14 bp, Artificial sequence
  Synthetic oligonucleotide
tctgacatcacaca

SEQ ID NO: 211 - DNA, 14 bp, Artificial sequence
  Synthetic oligonucleotide
atctgacatcacac

SEQ ID NO: 212 - DNA, 14 bp, Artificial sequence
  Synthetic oligonucleotide
ttccttaacccaac

SEQ ID NO: 213 - DNA, 14 bp, Artificial sequence
  Synthetic oligonucleotide
attccttaacccaa

SEQ ID NO: 214 - DNA, 14 bp, Artificial sequence
  Synthetic oligonucleotide
tattccttaaccca

SEQ ID NO: 215 - DNA, 14 bp, Artificial sequence
  Synthetic oligonucleotide
ctattccttaaccc

SEQ ID NO: 216 - DNA, 14 bp, Artificial sequence
  Synthetic oligonucleotide
tctattccttaacc

SEQ ID NO: 217 - DNA, 14 bp, Artificial sequence
  Synthetic oligonucleotide
gtctattccttaac

SEQ ID NO: 218 - DNA, 14 bp, Artificial sequence
  Synthetic oligonucleotide
catcaaatctcata

SEQ ID NO: 219 - DNA, 14 bp, Artificial sequence
  Synthetic oligonucleotide
gcatcaaatctcat

SEQ ID NO: 220 - DNA, 14 bp, Artificial sequence
  Synthetic oligonucleotide
tgcatcaaatctca

SEQ ID NO: 221 - DNA, 14 bp, Artificial sequence
  Synthetic oligonucleotide
atgcatcaaatctc

SEQ ID NO: 222 - DNA, 14 bp, Artificial sequence
  Synthetic oligonucleotide
aatgcatcaaatct

SEQ ID NO: 223 - DNA, 14 bp, Artificial sequence
  Synthetic oligonucleotide
attttaaacaaaca

SEQ ID NO: 224 - DNA, 14 bp, Artificial sequence
  Synthetic oligonucleotide
tattttaaacaaac

SEQ ID NO: 225 - DNA, 14 bp, Artificial sequence
  Synthetic oligonucleotide
ttattttaaacaaa

SEQ ID NO: 226 - DNA, 14 bp, Artificial sequence
  Synthetic oligonucleotide
attattttaaacaa

SEQ ID NO: 227 - DNA, 14 bp, Artificial sequence
  Synthetic oligonucleotide
aattattttaaaca

SEQ ID NO: 228 - DNA, 14 bp, Artificial sequence
  Synthetic oligonucleotide
gaattattttaaac

SEQ ID NO: 229 - DNA, 14 bp, Artificial sequence
  Synthetic oligonucleotide
ttttacaaatctac

SEQ ID NO: 230 - DNA, 14 bp, Artificial sequence
  Synthetic oligonucleotide
attttacaaatcta

SEQ ID NO: 231 - DNA, 14 bp, Artificial sequence
  Synthetic oligonucleotide
tattttacaaatct

SEQ ID NO: 232 - DNA, 14 bp, Artificial sequence
  Synthetic oligonucleotide
ttattttacaaatc

SEQ ID NO: 233 - DNA, 14 bp, Artificial sequence
  Synthetic oligonucleotide
tttattttacaaat

SEQ ID NO: 234 - DNA, 14 bp, Artificial sequence
  Synthetic oligonucleotide
atttattttacaaa

SEQ ID NO: 235 - DNA, 14 bp, Artificial sequence
  Synthetic oligonucleotide
catttattttacaa

SEQ ID NO: 236 - DNA, 14 bp, Artificial sequence
  Synthetic oligonucleotide
acatttattttaca

SEQ ID NO: 237 - DNA, 14 bp, Artificial sequence
  Synthetic oligonucleotide
aacatttattttac

SEQ ID NO: 238 - DNA, 14 bp, Artificial sequence
  Synthetic oligonucleotide
taacatttatttta

SEQ ID NO: 239 - DNA, 14 bp, Artificial sequence
  Synthetic oligonucleotide
aatttaatcattaa

SEQ ID NO: 240 - DNA, 14 bp, Artificial sequence
  Synthetic oligonucleotide
taatttaatcatta

SEQ ID NO: 241 - DNA, 14 bp, Artificial sequence
  Synthetic oligonucleotide
ataatttaatcatt

SEQ ID NO: 242 - DNA, 14 bp, Artificial sequence
  Synthetic oligonucleotide
aataatttaatcat

SEQ ID NO: 243 - DNA, 14 bp, Artificial sequence
  Synthetic oligonucleotide
aaataatttaatca

SEQ ID NO: 244 - DNA, 14 bp, Artificial sequence
  Synthetic oligonucleotide
taaataatttaatc

SEQ ID NO: 245 - DNA, 14 bp, Artificial sequence
  Synthetic oligonucleotide
ctaaataatttaat

SEQ ID NO: 246 - DNA, 14 bp, Artificial sequence
  Synthetic oligonucleotide
cctaaataatttaa

SEQ ID NO: 247 - DNA, 14 bp, Artificial sequence
  Synthetic oligonucleotide
ccctaaataattta

SEQ ID NO: 248 - DNA, 14 bp, Artificial sequence
  Synthetic oligonucleotide
cccctaaataattt

SEQ ID NO: 249 - DNA, 14 bp, Artificial sequence
  Synthetic oligonucleotide
tcccctaaataatt

SEQ ID NO: 250 - DNA, 14 bp, Artificial sequence
  Synthetic oligonucleotide
tatataaaaatcta

SEQ ID NO: 251 - DNA, 14 bp, Artificial sequence
  Synthetic oligonucleotide
ctatataaaaatct

SEQ ID NO: 252 - DNA, 14 bp, Artificial sequence
  Synthetic oligonucleotide
tctatataaaaatc

SEQ ID NO: 253 - DNA, 14 bp, Artificial sequence
  Synthetic oligonucleotide
atctatataaaaat

SEQ ID NO: 254 - DNA, 14 bp, Artificial sequence
  Synthetic oligonucleotide
tatctatataaaaa

SEQ ID NO: 255 - DNA, 14 bp, Artificial sequence
  Synthetic oligonucleotide
ttatctatataaaa

SEQ ID NO: 256 - DNA, 14 bp, Artificial sequence
  Synthetic oligonucleotide
tttatctatataaa

SEQ ID NO: 257 - DNA, 14 bp, Artificial sequence
  Synthetic oligonucleotide
ccccactctaatat

SEQ ID NO: 258 - DNA, 14 bp, Artificial sequence
  Synthetic oligonucleotide
gccccactctaata

SEQ ID NO: 259 - DNA, 14 bp, Artificial sequence
  Synthetic oligonucleotide
tgccccactctaat

SEQ ID NO: 260 - DNA, 14 bp, Artificial sequence
  Synthetic oligonucleotide
atgccccactctaa

SEQ ID NO: 261 - DNA, 14 bp, Artificial sequence
  Synthetic oligonucleotide
aatgccccactcta

SEQ ID NO: 262 - DNA, 14 bp, Artificial sequence
  Synthetic oligonucleotide
aaatgccccactct

SEQ ID NO: 263 - DNA, 14 bp, Artificial sequence
  Synthetic oligonucleotide
taaatgccccactc

SEQ ID NO: 264 - DNA, 14 bp, Artificial sequence
  Synthetic oligonucleotide
ttaaatgccccact

SEQ ID NO: 265 - DNA, 14 bp, Artificial sequence
  Synthetic oligonucleotide
atataaccaccaaa

SEQ ID NO: 266 - DNA, 14 bp, Artificial sequence
  Synthetic oligonucleotide
tatataaccaccaa

SEQ ID NO: 267 - DNA, 14 bp, Artificial sequence
  Synthetic oligonucleotide
atatataaccacca

SEQ ID NO: 268 - DNA, 14 bp, Artificial sequence
  Synthetic oligonucleotide
tatatataaccacc

SEQ ID NO: 269 - DNA, 14 bp, Artificial sequence
  Synthetic oligonucleotide
atatatataaccac

SEQ ID NO: 270 - DNA, 14 bp, Artificial sequence
  Synthetic oligonucleotide
aaaattcactatct

SEQ ID NO: 271 - DNA, 14 bp, Artificial sequence
  Synthetic oligonucleotide
gaaaattcactatc

SEQ ID NO: 272 - DNA, 14 bp, Artificial sequence
  Synthetic oligonucleotide
tgaaaattcactat

SEQ ID NO: 273 - DNA, 14 bp, Artificial sequence
  Synthetic oligonucleotide
ctgaaaattcacta

SEQ ID NO: 274 - DNA, 14 bp, Artificial sequence
  Synthetic oligonucleotide
tctgaaaattcact

SEQ ID NO: 275 - DNA, 14 bp, Artificial sequence
  Synthetic oligonucleotide
tactatatacatct

SEQ ID NO: 276 - DNA, 14 bp, Artificial sequence
  Synthetic oligonucleotide
ctactatatacatc

SEQ ID NO: 277 - DNA, 14 bp, Artificial sequence
  Synthetic oligonucleotide
tctactatatacat

SEQ ID NO: 278 - DNA, 14 bp, Artificial sequence
  Synthetic oligonucleotide
gtctactatataca

SEQ ID NO: 279 - DNA, 14 bp, Artificial sequence
  Synthetic oligonucleotide
agtctactatatac

SEQ ID NO: 280 - DNA, 14 bp, Artificial sequence
  Synthetic oligonucleotide
tagtctactatata

SEQ ID NO: 281 - DNA, 14 bp, Artificial sequence
  Synthetic oligonucleotide
ctagtctactatat

SEQ ID NO: 282 - DNA, 14 bp, Artificial sequence
  Synthetic oligonucleotide
actagtctactata

SEQ ID NO: 283 - DNA, 14 bp, Artificial sequence
  Synthetic oligonucleotide
aactagtctactat

SEQ ID NO: 284 - DNA, 14 bp, Artificial sequence
  Synthetic oligonucleotide
tattctacccataa

SEQ ID NO: 285 - DNA, 14 bp, Artificial sequence
  Synthetic oligonucleotide
atattctacccata

SEQ ID NO: 286 - DNA, 14 bp, Artificial sequence
  Synthetic oligonucleotide
tatattctacccat

SEQ ID NO: 287 - DNA, 14 bp, Artificial sequence
  Synthetic oligonucleotide
gtatattctaccca

SEQ ID NO: 288 - DNA, 14 bp, Artificial sequence
  Synthetic oligonucleotide
tgtatattctaccc

SEQ ID NO: 289 - DNA, 14 bp, Artificial sequence
  Synthetic oligonucleotide
atgtatattctacc

SEQ ID NO: 290 - DNA, 14 bp, Artificial sequence
  Synthetic oligonucleotide
ccacacaattccta

SEQ ID NO: 291 - DNA, 14 bp, Artificial sequence
  Synthetic oligonucleotide
accacacaattcct

SEQ ID NO: 292 - DNA, 14 bp, Artificial sequence
  Synthetic oligonucleotide
aaccacacaattcc

SEQ ID NO: 293 - DNA, 14 bp, Artificial sequence
  Synthetic oligonucleotide
aaaccacacaattc

SEQ ID NO: 294 - DNA, 14 bp, Artificial sequence
  Synthetic oligonucleotide
aaaaccacacaatt

SEQ ID NO: 295 - DNA, 14 bp, Artificial sequence
  Synthetic oligonucleotide
gaaaaccacacaat

SEQ ID NO: 296 - DNA, 14 bp, Artificial sequence
  Synthetic oligonucleotide
agaaaaccacacaa

SEQ ID NO: 297 - DNA, 14 bp, Artificial sequence
  Synthetic oligonucleotide
cagaaaaccacaca

SEQ ID NO: 298 - DNA, 14 bp, Artificial sequence
  Synthetic oligonucleotide
ccagaaaaccacac

SEQ ID NO: 299 - DNA, 14 bp, Artificial sequence
  Synthetic oligonucleotide
tccagaaaaccaca

SEQ ID NO: 300 - DNA, 14 bp, Artificial sequence
  Synthetic oligonucleotide
aaatccataaaaaa

SEQ ID NO: 301 - DNA, 14 bp, Artificial sequence
  Synthetic oligonucleotide
taaatccataaaaa

SEQ ID NO: 302 - DNA, 14 bp, Artificial sequence
  Synthetic oligonucleotide
ctaaatccataaaa

SEQ ID NO: 303 - DNA, 14 bp, Artificial sequence
  Synthetic oligonucleotide
actaaatccataaa

SEQ ID NO: 304 - DNA, 14 bp, Artificial sequence
  Synthetic oligonucleotide
cactaaatccataa

SEQ ID NO: 305 - DNA, 14 bp, Artificial sequence
  Synthetic oligonucleotide
tcactaaatccata

SEQ ID NO: 306 - DNA, 14 bp, Artificial sequence
  Synthetic oligonucleotide
atcactaaatccat

SEQ ID NO: 307 - DNA, 14 bp, Artificial sequence
  Synthetic oligonucleotide
tatcactaaatcca

SEQ ID NO: 308 - DNA, 14 bp, Artificial sequence
  Synthetic oligonucleotide
atatcactaaatcc

SEQ ID NO: 309 - DNA, 14 bp, Artificial sequence
  Synthetic oligonucleotide
tatatcactaaatc

SEQ ID NO: 310 - DNA, 14 bp, Artificial sequence
  Synthetic oligonucleotide
atatatcactaaat

SEQ ID NO: 311 - DNA, 14 bp, Artificial sequence
  Synthetic oligonucleotide
gatatatcactaaa

SEQ ID NO: 312 - DNA, 14 bp, Artificial sequence
  Synthetic oligonucleotide
agatatatcactaa

SEQ ID NO: 313 - DNA, 14 bp, Artificial sequence
  Synthetic oligonucleotide
tagatatatcacta

SEQ ID NO: 314 - DNA, 14 bp, Artificial sequence
  Synthetic oligonucleotide
tataaatttctcta

SEQ ID NO: 315 - DNA, 14 bp, Artificial sequence
  Synthetic oligonucleotide
atataaatttctct

SEQ ID NO: 316 - DNA, 14 bp, Artificial sequence
  Synthetic oligonucleotide
tatataaatttctc

SEQ ID NO: 317 - DNA, 14 bp, Artificial sequence
  Synthetic oligonucleotide
atatataaatttct

SEQ ID NO: 318 - DNA, 14 bp, Artificial sequence
  Synthetic oligonucleotide
catatataaatttc

SEQ ID NO: 319 - DNA, 14 bp, Artificial sequence
  Synthetic oligonucleotide
tcatatataaattt

SEQ ID NO: 320 - DNA, 14 bp, Artificial sequence
  Synthetic oligonucleotide
ctccattccaaatt

SEQ ID NO: 321 - DNA, 14 bp, Artificial sequence
  Synthetic oligonucleotide
actccattccaaat

SEQ ID NO: 322 - DNA, 14 bp, Artificial sequence
  Synthetic oligonucleotide
cactccattccaaa

SEQ ID NO: 323 - DNA, 14 bp, Artificial sequence
  Synthetic oligonucleotide
ccactccattccaa

SEQ ID NO: 324 - DNA, 14 bp, Artificial sequence
  Synthetic oligonucleotide
accactccattcca

SEQ ID NO: 325 - DNA, 14 bp, Artificial sequence
  Synthetic oligonucleotide
aaccactccattcc

SEQ ID NO: 326 - DNA, 14 bp, Artificial sequence
  Synthetic oligonucleotide
aaaccactccattc

SEQ ID NO: 327 - DNA, 14 bp, Artificial sequence
  Synthetic oligonucleotide
tcacacaaccatat

SEQ ID NO: 328 - DNA, 14 bp, Artificial sequence
  Synthetic oligonucleotide
atcacacaaccata

SEQ ID NO: 329 - DNA, 14 bp, Artificial sequence
  Synthetic oligonucleotide
gatcacacaaccat

SEQ ID NO: 330 - DNA, 14 bp, Artificial sequence
  Synthetic oligonucleotide
agatcacacaacca

SEQ ID NO: 331 - DNA, 14 bp, Artificial sequence
  Synthetic oligonucleotide
aagatcacacaacc

SEQ ID NO: 332 - DNA, 14 bp, Artificial sequence
  Synthetic oligonucleotide
aaagatcacacaac

SEQ ID NO: 333 - DNA, 14 bp, Artificial sequence
  Synthetic oligonucleotide
aaaagatcacacaa

SEQ ID NO: 334 - DNA, 14 bp, Artificial sequence
  Synthetic oligonucleotide
taaaagatcacaca

SEQ ID NO: 335 - DNA, 14 bp, Artificial sequence
  Synthetic oligonucleotide
ttcatttctaaaaa

SEQ ID NO: 336 - DNA, 14 bp, Artificial sequence
  Synthetic oligonucleotide
tttcatttctaaaa

SEQ ID NO: 337 - DNA, 14 bp, Artificial sequence
  Synthetic oligonucleotide
ctttcatttctaaa

SEQ ID NO: 338 - DNA, 14 bp, Artificial sequence
  Synthetic oligonucleotide
tctttcatttctaa

SEQ ID NO: 339 - DNA, 14 bp, Artificial sequence
  Synthetic oligonucleotide
atctttcatttcta

SEQ ID NO: 340 - DNA, 14 bp, Artificial sequence
  Synthetic oligonucleotide
gatctttcatttct

SEQ ID NO: 341 - DNA, 14 bp, Artificial sequence
  Synthetic oligonucleotide
tgatctttcatttc

SEQ ID NO: 342 - DNA, 14 bp, Artificial sequence
  Synthetic oligonucleotide
atgatctttcattt

SEQ ID NO: 343 - DNA, 14 bp, Artificial sequence
  Synthetic oligonucleotide
ataaaaacccactt

SEQ ID NO: 344 - DNA, 14 bp, Artificial sequence
  Synthetic oligonucleotide
cataaaaacccact

SEQ ID NO: 345 - DNA, 14 bp, Artificial sequence
  Synthetic oligonucleotide
acataaaaacccac

SEQ ID NO: 346 - DNA, 14 bp, Artificial sequence
  Synthetic oligonucleotide
cacataaaaaccca

SEQ ID NO: 347 - DNA, 14 bp, Artificial sequence
  Synthetic oligonucleotide
tcacataaaaaccc

SEQ ID NO: 348 - DNA, 14 bp, Artificial sequence
  Synthetic oligonucleotide
atcacataaaaacc

SEQ ID NO: 349 - DNA, 14 bp, Artificial sequence
  Synthetic oligonucleotide
catcacataaaaac

SEQ ID NO: 350 - DNA, 14 bp, Artificial sequence
  Synthetic oligonucleotide
tcatcacataaaaa

SEQ ID NO: 351 - DNA, 14 bp, Artificial sequence
  Synthetic oligonucleotide
gtcatcacataaaa

SEQ ID NO: 352 - DNA, 14 bp, Artificial sequence
  Synthetic oligonucleotide
agtcatcacataaa

SEQ ID NO: 353 - DNA, 14 bp, Artificial sequence
  Synthetic oligonucleotide
tagtcatcacataa

SEQ ID NO: 354 - DNA, 14 bp, Artificial sequence
  Synthetic oligonucleotide
atagtcatcacata

SEQ ID NO: 355 - DNA, 14 bp, Artificial sequence
  Synthetic oligonucleotide
catagtcatcacat

SEQ ID NO: 356 - DNA, 14 bp, Artificial sequence
  Synthetic oligonucleotide
taaatacaaatcta

SEQ ID NO: 357 - DNA, 14 bp, Artificial sequence
  Synthetic oligonucleotide
ctaaatacaaatct

SEQ ID NO: 358 - DNA, 14 bp, Artificial sequence
  Synthetic oligonucleotide
gctaaatacaaatc

SEQ ID NO: 359 - DNA, 14 bp, Artificial sequence
  Synthetic oligonucleotide
tgctaaatacaaat

SEQ ID NO: 360 - DNA, 14 bp, Artificial sequence
  Synthetic oligonucleotide
atgctaaatacaaa

SEQ ID NO: 361 - DNA, 14 bp, Artificial sequence
  Synthetic oligonucleotide
tatgctaaatacaa

SEQ ID NO: 362 - DNA, 14 bp, Artificial sequence
  Synthetic oligonucleotide
aatcttacactaaa

SEQ ID NO: 363 - DNA, 14 bp, Artificial sequence
  Synthetic oligonucleotide
taatcttacactaa

SEQ ID NO: 364 - DNA, 14 bp, Artificial sequence
  Synthetic oligonucleotide
ataatcttacacta

SEQ ID NO: 365 - DNA, 14 bp, Artificial sequence
  Synthetic oligonucleotide
aataatcttacact

SEQ ID NO: 366 - DNA, 14 bp, Artificial sequence
  Synthetic oligonucleotide
gaataatcttacac

SEQ ID NO: 367 - DNA, 14 bp, Artificial sequence
  Synthetic oligonucleotide
tgaataatcttaca

SEQ ID NO: 368 - DNA, 14 bp, Artificial sequence
  Synthetic oligonucleotide
atgaataatcttac

SEQ ID NO: 369 - DNA, 14 bp, Artificial sequence
  Synthetic oligonucleotide
caaaattctaataa

SEQ ID NO: 370 - DNA, 14 bp, Artificial sequence
  Synthetic oligonucleotide
tcaaaattctaata

SEQ ID NO: 371 - DNA, 14 bp, Artificial sequence
  Synthetic oligonucleotide
ttcaaaattctaat

SEQ ID NO: 372 - DNA, 14 bp, Artificial sequence
  Synthetic oligonucleotide
attcaaaattctaa

SEQ ID NO: 373 - DNA, 14 bp, Artificial sequence
  Synthetic oligonucleotide
gattcaaaattcta

SEQ ID NO: 374 - DNA, 14 bp, Artificial sequence
  Synthetic oligonucleotide
agattcaaaattct

SEQ ID NO: 375 - DNA, 14 bp, Artificial sequence
  Synthetic oligonucleotide
attactacaaccaa

SEQ ID NO: 376 - DNA, 14 bp, Artificial sequence
  Synthetic oligonucleotide
cattactacaacca

SEQ ID NO: 377 - DNA, 14 bp, Artificial sequence
  Synthetic oligonucleotide
ccattactacaacc

SEQ ID NO: 378 - DNA, 14 bp, Artificial sequence
  Synthetic oligonucleotide
accattactacaac

SEQ ID NO: 379 - DNA, 14 bp, Artificial sequence
  Synthetic oligonucleotide
aaccattactacaa

SEQ ID NO: 380 - DNA, 14 bp, Artificial sequence
  Synthetic oligonucleotide
aaaccattactaca

SEQ ID NO: 381 - DNA, 14 bp, Artificial sequence
  Synthetic oligonucleotide
gaaaccattactac

SEQ ID NO: 382 - DNA, 14 bp, Artificial sequence
  Synthetic oligonucleotide
tgaaaccattacta

SEQ ID NO: 383 - DNA, 14 bp, Artificial sequence
  Synthetic oligonucleotide
atgaaaccattact

SEQ ID NO: 384 - DNA, 14 bp, Artificial sequence
  Synthetic oligonucleotide
atttttaaaaacac

SEQ ID NO: 385 - DNA, 14 bp, Artificial sequence
  Synthetic oligonucleotide
aatttttaaaaaca

SEQ ID NO: 386 - DNA, 14 bp, Artificial sequence
  Synthetic oligonucleotide
taatttttaaaaac

SEQ ID NO: 387 - DNA, 14 bp, Artificial sequence
  Synthetic oligonucleotide
ataatttttaaaaa

SEQ ID NO: 388 - DNA, 14 bp, Artificial sequence
  Synthetic oligonucleotide
cataatttttaaaa

SEQ ID NO: 389 - DNA, 14 bp, Artificial sequence
  Synthetic oligonucleotide
tcataatttttaaa

SEQ ID NO: 390 - DNA, 14 bp, Artificial sequence
  Synthetic oligonucleotide
atcataatttttaa

SEQ ID NO: 391 - DNA, 14 bp, Artificial sequence
  Synthetic oligonucleotide
ctttatacaaaaaa

SEQ ID NO: 392 - DNA, 14 bp, Artificial sequence
  Synthetic oligonucleotide
actttatacaaaaa

SEQ ID NO: 393 - DNA, 14 bp, Artificial sequence
  Synthetic oligonucleotide
tactttatacaaaa

SEQ ID NO: 394 - DNA, 14 bp, Artificial sequence
  Synthetic oligonucleotide
ttactttatacaaa

SEQ ID NO: 395 - DNA, 14 bp, Artificial sequence
  Synthetic oligonucleotide
cttactttatacaa

SEQ ID NO: 396 - DNA, 14 bp, Artificial sequence
  Synthetic oligonucleotide
gcttactttataca

SEQ ID NO: 397 - DNA, 14 bp, Artificial sequence
  Synthetic oligonucleotide
tgcttactttatac

SEQ ID NO: 398 - DNA, 14 bp, Artificial sequence
  Synthetic oligonucleotide
tctcaaaataataa

SEQ ID NO: 399 - DNA, 14 bp, Artificial sequence
  Synthetic oligonucleotide
ctctcaaaataata

SEQ ID NO: 400 - DNA, 14 bp, Artificial sequence
  Synthetic oligonucleotide
tctctcaaaataat

SEQ ID NO: 401 - DNA, 14 bp, Artificial sequence
  Synthetic oligonucleotide
atctctcaaaataa

SEQ ID NO: 402 - DNA, 14 bp, Artificial sequence
  Synthetic oligonucleotide
aatctctcaaaata

SEQ ID NO: 403 - DNA, 14 bp, Artificial sequence
  Synthetic oligonucleotide
aaatctctcaaaat

SEQ ID NO: 404 - DNA, 14 bp, Artificial sequence
  Synthetic oligonucleotide
taaatctctcaaaa

SEQ ID NO: 405 - DNA, 14 bp, Artificial sequence
  Synthetic oligonucleotide
ttaaatctctcaaa

SEQ ID NO: 406 - DNA, 14 bp, Artificial sequence
  Synthetic oligonucleotide
tttaaatctctcaa

SEQ ID NO: 407 - DNA, 14 bp, Artificial sequence
  Synthetic oligonucleotide
ttttaaatctctca

SEQ ID NO: 408 - DNA, 14 bp, Artificial sequence
  Synthetic oligonucleotide
taatactttttcca

SEQ ID NO: 409 - DNA, 14 bp, Artificial sequence
  Synthetic oligonucleotide
ttaatactttttcc

SEQ ID NO: 410 - DNA, 14 bp, Artificial sequence
  Synthetic oligonucleotide
gttaatactttttc

SEQ ID NO: 411 - DNA, 14 bp, Artificial sequence
  Synthetic oligonucleotide
tgttaatacttttt

SEQ ID NO: 412 - DNA, 14 bp, Artificial sequence
  Synthetic oligonucleotide
atgttaatactttt

SEQ ID NO: 413 - DNA, 14 bp, Artificial sequence
  Synthetic oligonucleotide
ttatcactaccaca

SEQ ID NO: 414 - DNA, 14 bp, Artificial sequence
  Synthetic oligonucleotide
tttatcactaccac

SEQ ID NO: 415 - DNA, 14 bp, Artificial sequence
  Synthetic oligonucleotide
atttatcactacca

SEQ ID NO: 416 - DNA, 14 bp, Artificial sequence
  Synthetic oligonucleotide
catttatcactacc

SEQ ID NO: 417 - DNA, 14 bp, Artificial sequence
  Synthetic oligonucleotide
tcatttatcactac

SEQ ID NO: 418 - DNA, 14 bp, Artificial sequence
  Synthetic oligonucleotide
atcatttatcacta

SEQ ID NO: 419 - DNA, 14 bp, Artificial sequence
  Synthetic oligonucleotide
catcatttatcact

SEQ ID NO: 420 - DNA, 14 bp, Artificial sequence
  Synthetic oligonucleotide
acatcatttatcac

SEQ ID NO: 421 - DNA, 14 bp, Artificial sequence
  Synthetic oligonucleotide
aacatcatttatca

SEQ ID NO: 422 - DNA, 14 bp, Artificial sequence
  Synthetic oligonucleotide
taacatcatttatc

SEQ ID NO: 423 - DNA, 14 bp, Artificial sequence
  Synthetic oligonucleotide
ttaacatcatttat

SEQ ID NO: 424 - DNA, 14 bp, Artificial sequence
  Synthetic oligonucleotide
attaacatcattta

SEQ ID NO: 425 - DNA, 14 bp, Artificial sequence
  Synthetic oligonucleotide
aattaacatcattt

SEQ ID NO: 426 - DNA, 14 bp, Artificial sequence
  Synthetic oligonucleotide
taattaacatcatt

SEQ ID NO: 427 - DNA, 14 bp, Artificial sequence
  Synthetic oligonucleotide
ctaattaacatcat

SEQ ID NO: 428 - DNA, 14 bp, Artificial sequence
  Synthetic oligonucleotide
cctaattaacatca

SEQ ID NO: 429 - DNA, 14 bp, Artificial sequence
  Synthetic oligonucleotide
ccctaattaacatc

SEQ ID NO: 430 - DNA, 14 bp, Artificial sequence
  Synthetic oligonucleotide
gccctaattaacat

SEQ ID NO: 431 - DNA, 14 bp, Artificial sequence
  Synthetic oligonucleotide
ggccctaattaaca

SEQ ID NO: 432 - DNA, 14 bp, Artificial sequence
  Synthetic oligonucleotide
cggccctaattaac

SEQ ID NO: 433 - DNA, 14 bp, Artificial sequence
  Synthetic oligonucleotide
aaacacattttttt

SEQ ID NO: 434 - DNA, 14 bp, Artificial sequence
  Synthetic oligonucleotide
taaacacatttttt

SEQ ID NO: 435 - DNA, 14 bp, Artificial sequence
  Synthetic oligonucleotide
ataaacacattttt

SEQ ID NO: 436 - DNA, 14 bp, Artificial sequence
  Synthetic oligonucleotide
tataaacacatttt

SEQ ID NO: 437 - DNA, 14 bp, Artificial sequence
  Synthetic oligonucleotide
atataaacacattt

SEQ ID NO: 438 - DNA, 14 bp, Artificial sequence
  Synthetic oligonucleotide
catataaacacatt

SEQ ID NO: 439 - DNA, 14 bp, Artificial sequence
  Synthetic oligonucleotide
acatataaacacat

SEQ ID NO: 440 - DNA, 14 bp, Artificial sequence
  Synthetic oligonucleotide
aacatataaacaca

SEQ ID NO: 441 - DNA, 14 bp, Artificial sequence
  Synthetic oligonucleotide
taacatataaacac

SEQ ID NO: 442 - DNA, 14 bp, Artificial sequence
  Synthetic oligonucleotide
ataacatataaaca

SEQ ID NO: 443 - DNA, 14 bp, Artificial sequence
  Synthetic oligonucleotide
tataacatataaac

SEQ ID NO: 444 - DNA, 14 bp, Artificial sequence
  Synthetic oligonucleotide
atataacatataaa

SEQ ID NO: 445 - DNA, 14 bp, Artificial sequence
  Synthetic oligonucleotide
catataacatataa

SEQ ID NO: 446 - DNA, 14 bp, Artificial sequence
  Synthetic oligonucleotide
acatataacatata

SEQ ID NO: 447 - DNA, 14 bp, Artificial sequence
  Synthetic oligonucleotide
cacatataacatat

SEQ ID NO: 448 - DNA, 14 bp, Artificial sequence
  Synthetic oligonucleotide
tcacatataacata

SEQ ID NO: 449 - DNA, 14 bp, Artificial sequence
  Synthetic oligonucleotide
atcacatataacat

SEQ ID NO: 450 - DNA, 14 bp, Artificial sequence
  Synthetic oligonucleotide
tatcacatataaca

SEQ ID NO: 451 - DNA, 14 bp, Artificial sequence
  Synthetic oligonucleotide
ctatcacatataac

SEQ ID NO: 452 - DNA, 14 bp, Artificial sequence
  Synthetic oligonucleotide
actatcacatataa

SEQ ID NO: 453 - DNA, 14 bp, Artificial sequence
  Synthetic oligonucleotide
cactatcacatata

SEQ ID NO: 454 - DNA, 14 bp, Artificial sequence
  Synthetic oligonucleotide
gtccaacataactc

SEQ ID NO: 455 - DNA, 14 bp, Artificial sequence
  Synthetic oligonucleotide
agtccaacataact

SEQ ID NO: 456 - DNA, 14 bp, Artificial sequence
  Synthetic oligonucleotide
cagtccaacataac

SEQ ID NO: 457 - DNA, 14 bp, Artificial sequence
  Synthetic oligonucleotide
tcagtccaacataa

SEQ ID NO: 458 - DNA, 14 bp, Artificial sequence
  Synthetic oligonucleotide
atcagtccaacata

SEQ ID NO: 459 - DNA, 14 bp, Artificial sequence
  Synthetic oligonucleotide
tatcagtccaacat

SEQ ID NO: 460 - DNA, 14 bp, Artificial sequence
  Synthetic oligonucleotide
aaaccctcccaaaa

SEQ ID NO: 461 - DNA, 14 bp, Artificial sequence
  Synthetic oligonucleotide
taaaccctcccaaa

SEQ ID NO: 462 - DNA, 14 bp, Artificial sequence
  Synthetic oligonucleotide
ttaaaccctcccaa

SEQ ID NO: 463 - DNA, 14 bp, Artificial sequence
  Synthetic oligonucleotide
attaaaccctccca

SEQ ID NO: 464 - DNA, 14 bp, Artificial sequence
  Synthetic oligonucleotide
cattaaaccctccc

SEQ ID NO: 465 - DNA, 14 bp, Artificial sequence
  Synthetic oligonucleotide
acattaaaccctcc

SEQ ID NO: 466 - DNA, 14 bp, Artificial sequence
  Synthetic oligonucleotide
aacattaaaccctc

SEQ ID NO: 467 - DNA, 14 bp, Artificial sequence
  Synthetic oligonucleotide
aaacattaaaccct

SEQ ID NO: 468 - DNA, 14 bp, Artificial sequence
  Synthetic oligonucleotide
taaacattaaaccc

SEQ ID NO: 469 - DNA, 14 bp, Artificial sequence
  Synthetic oligonucleotide
ataaacattaaacc

SEQ ID NO: 470 - DNA, 14 bp, Artificial sequence
  Synthetic oligonucleotide
tataaacattaaac

SEQ ID NO: 471 - DNA, 14 bp, Artificial sequence
  Synthetic oligonucleotide
ctataaacattaaa

SEQ ID NO: 472 - DNA, 14 bp, Artificial sequence
  Synthetic oligonucleotide
actataaacattaa

SEQ ID NO: 473 - DNA, 14 bp, Artificial sequence
  Synthetic oligonucleotide
aactataaacatta

SEQ ID NO: 474 - DNA, 14 bp, Artificial sequence
  Synthetic oligonucleotide
aaactataaacatt

SEQ ID NO: 475 - DNA, 14 bp, Artificial sequence
  Synthetic oligonucleotide
taaactataaacat

SEQ ID NO: 476 - DNA, 14 bp, Artificial sequence
  Synthetic oligonucleotide
ttaaactataaaca

SEQ ID NO: 477 - DNA, 14 bp, Artificial sequence
  Synthetic oligonucleotide
tttaaactataaac

SEQ ID NO: 478 - DNA, 14 bp, Artificial sequence
  Synthetic oligonucleotide
ctttaaactataaa

SEQ ID NO: 479 - DNA, 14 bp, Artificial sequence
  Synthetic oligonucleotide
gctttaaactataa

SEQ ID NO: 480 - DNA, 14 bp, Artificial sequence
  Synthetic oligonucleotide
tgctttaaactata

SEQ ID NO: 481 - DNA, 14 bp, Artificial sequence
  Synthetic oligonucleotide
cagcctatcaccac

SEQ ID NO: 482 - DNA, 14 bp, Artificial sequence
  Synthetic oligonucleotide
acagcctatcacca

SEQ ID NO: 483 - DNA, 14 bp, Artificial sequence
  Synthetic oligonucleotide
cacagcctatcacc

SEQ ID NO: 484 - DNA, 14 bp, Artificial sequence
  Synthetic oligonucleotide
tcacagcctatcac

SEQ ID NO: 485 - DNA, 14 bp, Artificial sequence
  Synthetic oligonucleotide
atcacagcctatca

SEQ ID NO: 486 - DNA, 14 bp, Artificial sequence
  Synthetic oligonucleotide
aatcacagcctatc

SEQ ID NO: 487 - DNA, 14 bp, Artificial sequence
  Synthetic oligonucleotide
aaatcacagcctat

SEQ ID NO: 488 - DNA, 14 bp, Artificial sequence
  Synthetic oligonucleotide
caaatcacagccta

SEQ ID NO: 489 - DNA, 14 bp, Artificial sequence
  Synthetic oligonucleotide
ccaaatcacagcct

SEQ ID NO: 490 - DNA, 14 bp, Artificial sequence
  Synthetic oligonucleotide
cccaaatcacagcc

SEQ ID NO: 491 - DNA, 14 bp, Artificial sequence
  Synthetic oligonucleotide
acccaaatcacagc

SEQ ID NO: 492 - DNA, 14 bp, Artificial sequence
  Synthetic oligonucleotide
cacccaaatcacag

SEQ ID NO: 493 - DNA, 14 bp, Artificial sequence
  Synthetic oligonucleotide
tcacccaaatcaca

SEQ ID NO: 494 - DNA, 14 bp, Artificial sequence
  Synthetic oligonucleotide
gtcacccaaatcac

SEQ ID NO: 495 - DNA, 14 bp, Artificial sequence
  Synthetic oligonucleotide
cgtcacccaaatca

SEQ ID NO: 496 - DNA, 14 bp, Artificial sequence
  Synthetic oligonucleotide
gcgtcacccaaatc

SEQ ID NO: 497 - DNA, 14 bp, Artificial sequence
  Synthetic oligonucleotide
agcgtcacccaaat

SEQ ID NO: 498 - DNA, 14 bp, Artificial sequence
  Synthetic oligonucleotide
atcctaaaatcact

SEQ ID NO: 499 - DNA, 14 bp, Artificial sequence
  Synthetic oligonucleotide
gatcctaaaatcac

SEQ ID NO: 500 - DNA, 14 bp, Artificial sequence
  Synthetic oligonucleotide
agatcctaaaatca

SEQ ID NO: 501 - DNA, 14 bp, Artificial sequence
  Synthetic oligonucleotide
cagatcctaaaatc

SEQ ID NO: 502 - DNA, 14 bp, Artificial sequence
  Synthetic oligonucleotide
tcagatcctaaaat

SEQ ID NO: 503 - DNA, 14 bp, Artificial sequence
  Synthetic oligonucleotide
aaaccaatcatcat

SEQ ID NO: 504 - DNA, 14 bp, Artificial sequence
  Synthetic oligonucleotide
aaaaccaatcatca

SEQ ID NO: 505 - DNA, 14 bp, Artificial sequence
  Synthetic oligonucleotide
taaaaccaatcatc

SEQ ID NO: 506 - DNA, 14 bp, Artificial sequence
  Synthetic oligonucleotide
gtaaaaccaatcat

SEQ ID NO: 507 - DNA, 14 bp, Artificial sequence
  Synthetic oligonucleotide
agtaaaaccaatca

SEQ ID NO: 508 - DNA, 14 bp, Artificial sequence
  Synthetic oligonucleotide
aagtaaaaccaatc

SEQ ID NO: 509 - DNA, 14 bp, Artificial sequence
  Synthetic oligonucleotide
aaagtaaaaccaat

SEQ ID NO: 510 - DNA, 14 bp, Artificial sequence
  Synthetic oligonucleotide
catctctactaaaa

SEQ ID NO: 511 - DNA, 14 bp, Artificial sequence
  Synthetic oligonucleotide
ccatctctactaaa

SEQ ID NO: 512 - DNA, 14 bp, Artificial sequence
  Synthetic oligonucleotide
tccatctctactaa

SEQ ID NO: 513 - DNA, 14 bp, Artificial sequence
  Synthetic oligonucleotide
ttccatctctacta

SEQ ID NO: 514 - DNA, 14 bp, Artificial sequence
  Synthetic oligonucleotide
cttccatctctact

SEQ ID NO: 515 - DNA, 14 bp, Artificial sequence
  Synthetic oligonucleotide
ccttccatctctac

SEQ ID NO: 516 - DNA, 14 bp, Artificial sequence
  Synthetic oligonucleotide
cccttccatctcta

SEQ ID NO: 517 - DNA, 14 bp, Artificial sequence
  Synthetic oligonucleotide
acataacaaaccca

SEQ ID NO: 518 - DNA, 14 bp, Artificial sequence
  Synthetic oligonucleotide
tacataacaaaccc

SEQ ID NO: 519 - DNA, 14 bp, Artificial sequence
  Synthetic oligonucleotide
ctacataacaaacc

SEQ ID NO: 520 - DNA, 14 bp, Artificial sequence
  Synthetic oligonucleotide
actacataacaaac

SEQ ID NO: 521 - DNA, 14 bp, Artificial sequence
  Synthetic oligonucleotide
aactacataacaaa

SEQ ID NO: 522 - DNA, 14 bp, Artificial sequence
  Synthetic oligonucleotide
taactacataacaa

SEQ ID NO: 523 - DNA, 14 bp, Artificial sequence
  Synthetic oligonucleotide
ataactacataaca

SEQ ID NO: 524 - DNA, 14 bp, Artificial sequence
  Synthetic oligonucleotide
aataactacataac

SEQ ID NO: 525 - DNA, 14 bp, Artificial sequence
  Synthetic oligonucleotide
caataactacataa

SEQ ID NO: 526 - DNA, 14 bp, Artificial sequence
  Synthetic oligonucleotide
acaataactacata

SEQ ID NO: 527 - DNA, 14 bp, Artificial sequence
  Synthetic oligonucleotide
cacaataactacat

SEQ ID NO: 528 - DNA, 14 bp, Artificial sequence
  Synthetic oligonucleotide
tcacaataactaca

SEQ ID NO: 529 - DNA, 14 bp, Artificial sequence
  Synthetic oligonucleotide
ttcacaataactac

SEQ ID NO: 530 - DNA, 14 bp, Artificial sequence
  Synthetic oligonucleotide
attcacaataacta

SEQ ID NO: 531 - DNA, 14 bp, Artificial sequence
  Synthetic oligonucleotide
aattcacaataact

SEQ ID NO: 532 - DNA, 14 bp, Artificial sequence
  Synthetic oligonucleotide
gaattcacaataac

SEQ ID NO: 533 - DNA, 14 bp, Artificial sequence
  Synthetic oligonucleotide
tgaattcacaataa

SEQ ID NO: 534 - DNA, 14 bp, Artificial sequence
  Synthetic oligonucleotide
ctaaaacaatctaa

SEQ ID NO: 535 - DNA, 14 bp, Artificial sequence
  Synthetic oligonucleotide
cctaaaacaatcta

SEQ ID NO: 536 - DNA, 14 bp, Artificial sequence
  Synthetic oligonucleotide
acctaaaacaatct

SEQ ID NO: 537 - DNA, 14 bp, Artificial sequence
  Synthetic oligonucleotide
tacctaaaacaatc

SEQ ID NO: 538 - DNA, 14 bp, Artificial sequence
  Synthetic oligonucleotide
atacctaaaacaat

SEQ ID NO: 539 - DNA, 14 bp, Artificial sequence
  Synthetic oligonucleotide
tatacctaaaacaa

SEQ ID NO: 540 - DNA, 14 bp, Artificial sequence
  Synthetic oligonucleotide
ctatacctaaaaca

SEQ ID NO: 541 - DNA, 14 bp, Artificial sequence
  Synthetic oligonucleotide
gctatacctaaaac

SEQ ID NO: 542 - DNA, 14 bp, Artificial sequence
  Synthetic oligonucleotide
ttgtaactaaaaat

SEQ ID NO: 543 - DNA, 14 bp, Artificial sequence
  Synthetic oligonucleotide
cttgtaactaaaaa

SEQ ID NO: 544 - DNA, 14 bp, Artificial sequence
  Synthetic oligonucleotide
ccttgtaactaaaa

SEQ ID NO: 545 - DNA, 14 bp, Artificial sequence
  Synthetic oligonucleotide
cccttgtaactaaa

SEQ ID NO: 546 - DNA, 14 bp, Artificial sequence
  Synthetic oligonucleotide
ccccttgtaactaa

SEQ ID NO: 547 - DNA, 14 bp, Artificial sequence
  Synthetic oligonucleotide
accccttgtaacta

SEQ ID NO: 548 - DNA, 14 bp, Artificial sequence
  Synthetic oligonucleotide
caccccttgtaact

SEQ ID NO: 549 - DNA, 14 bp, Artificial sequence
  Synthetic oligonucleotide
acaccccttgtaac

SEQ ID NO: 550 - DNA, 14 bp, Artificial sequence
  Synthetic oligonucleotide
ttcatatatacatc

SEQ ID NO: 551 - DNA, 14 bp, Artificial sequence
  Synthetic oligonucleotide
cttcatatatacat

SEQ ID NO: 552 - DNA, 14 bp, Artificial sequence
  Synthetic oligonucleotide
ccttcatatataca

SEQ ID NO: 553 - DNA, 14 bp, Artificial sequence
  Synthetic oligonucleotide
cccttcatatatac

SEQ ID NO: 554 - DNA, 14 bp, Artificial sequence
  Synthetic oligonucleotide
acccttcatatata

SEQ ID NO: 555 - DNA, 14 bp, Artificial sequence
  Synthetic oligonucleotide
tacccttcatatat

SEQ ID NO: 556 - DNA, 14 bp, Artificial sequence
  Synthetic oligonucleotide
ttacccttcatata

SEQ ID NO: 557 - DNA, 14 bp, Artificial sequence
  Synthetic oligonucleotide
attacccttcatat

SEQ ID NO: 558 - DNA, 14 bp, Artificial sequence
  Synthetic oligonucleotide
cattacccttcata

SEQ ID NO: 559 - DNA, 14 bp, Artificial sequence
  Synthetic oligonucleotide
acattacccttcat

SEQ ID NO: 560 - DNA, 14 bp, Artificial sequence
  Synthetic oligonucleotide
tacattacccttca

SEQ ID NO: 561 - DNA, 14 bp, Artificial sequence
  Synthetic oligonucleotide
tcttatacttacta

SEQ ID NO: 562 - DNA, 14 bp, Artificial sequence
  Synthetic oligonucleotide
ttcttatacttact

SEQ ID NO: 563 - DNA, 14 bp, Artificial sequence
  Synthetic oligonucleotide
attcttatacttac

SEQ ID NO: 564 - DNA, 14 bp, Artificial sequence
  Synthetic oligonucleotide
gattcttatactta

SEQ ID NO: 565 - DNA, 14 bp, Artificial sequence
  Synthetic oligonucleotide
tgattcttatactt

SEQ ID NO: 566 - DNA, 14 bp, Artificial sequence
  Synthetic oligonucleotide
atgattcttatact

SEQ ID NO: 567 - DNA, 14 bp, Artificial sequence
  Synthetic oligonucleotide
aacttcactaaaat

SEQ ID NO: 568 - DNA, 14 bp, Artificial sequence
  Synthetic oligonucleotide
aaacttcactaaaa

SEQ ID NO: 569 - DNA, 14 bp, Artificial sequence
  Synthetic oligonucleotide
taaacttcactaaa

SEQ ID NO: 570 - DNA, 14 bp, Artificial sequence
  Synthetic oligonucleotide
ataaacttcactaa

SEQ ID NO: 571 - DNA, 14 bp, Artificial sequence
  Synthetic oligonucleotide
aataaacttcacta

SEQ ID NO: 572 - DNA, 14 bp, Artificial sequence
  Synthetic oligonucleotide
taataaacttcact

SEQ ID NO: 573 - DNA, 14 bp, Artificial sequence
  Synthetic oligonucleotide
ctaataaacttcac

SEQ ID NO: 574 - DNA, 14 bp, Artificial sequence
  Synthetic oligonucleotide
actaataaacttca

SEQ ID NO: 575 - DNA, 14 bp, Artificial sequence
  Synthetic oligonucleotide
aactaataaacttc

SEQ ID NO: 576 - DNA, 14 bp, Artificial sequence
  Synthetic oligonucleotide
aatcttctatttta

SEQ ID NO: 577 - DNA, 14 bp, Artificial sequence
  Synthetic oligonucleotide
caatcttctatttt

SEQ ID NO: 578 - DNA, 14 bp, Artificial sequence
  Synthetic oligonucleotide
ccaatcttctattt

SEQ ID NO: 579 - DNA, 14 bp, Artificial sequence
  Synthetic oligonucleotide
accaatcttctatt

SEQ ID NO: 580 - DNA, 14 bp, Artificial sequence
  Synthetic oligonucleotide
aaccaatcttctat

SEQ ID NO: 581 - DNA, 14 bp, Artificial sequence
  Synthetic oligonucleotide
caaccaatcttcta

SEQ ID NO: 582 - DNA, 14 bp, Artificial sequence
  Synthetic oligonucleotide
gcaaccaatcttct

SEQ ID NO: 583 - DNA, 14 bp, Artificial sequence
  Synthetic oligonucleotide
tgcaaccaatcttc

SEQ ID NO: 584 - DNA, 14 bp, Artificial sequence
  Synthetic oligonucleotide
ctgcaaccaatctt

SEQ ID NO: 585 - DNA, 14 bp, Artificial sequence
  Synthetic oligonucleotide
actgcaaccaatct

SEQ ID NO: 586 - DNA, 14 bp, Artificial sequence
  Synthetic oligonucleotide
aactgcaaccaatc

SEQ ID NO: 587 - DNA, 14 bp, Artificial sequence
  Synthetic oligonucleotide
taactgcaaccaat

SEQ ID NO: 588 - DNA, 14 bp, Artificial sequence
  Synthetic oligonucleotide
tacaacacacatca

SEQ ID NO: 589 - DNA, 14 bp, Artificial sequence
  Synthetic oligonucleotide
atacaacacacatc

SEQ ID NO: 590 - DNA, 14 bp, Artificial sequence
  Synthetic oligonucleotide
aatacaacacacat

SEQ ID NO: 591 - DNA, 14 bp, Artificial sequence
  Synthetic oligonucleotide
gaatacaacacaca

SEQ ID NO: 592 - DNA, 14 bp, Artificial sequence
  Synthetic oligonucleotide
tgaatacaacacac

SEQ ID NO: 593 - DNA, 14 bp, Artificial sequence
  Synthetic oligonucleotide
atgaatacaacaca

SEQ ID NO: 594 - DNA, 14 bp, Artificial sequence
  Synthetic oligonucleotide
cctaataaaatata

SEQ ID NO: 595 - DNA, 14 bp, Artificial sequence
  Synthetic oligonucleotide
tcctaataaaatat

SEQ ID NO: 596 - DNA, 14 bp, Artificial sequence
  Synthetic oligonucleotide
ctcctaataaaata

SEQ ID NO: 597 - DNA, 14 bp, Artificial sequence
  Synthetic oligonucleotide
actcctaataaaat

SEQ ID NO: 598 - DNA, 14 bp, Artificial sequence
  Synthetic oligonucleotide
tactcctaataaaa

SEQ ID NO: 599 - DNA, 14 bp, Artificial sequence
  Synthetic oligonucleotide
ctactcctaataaa

SEQ ID NO: 600 - DNA, 14 bp, Artificial sequence
  Synthetic oligonucleotide
actactcctaataa

SEQ ID NO: 601 - DNA, 14 bp, Artificial sequence
  Synthetic oligonucleotide
aactactcctaata

SEQ ID NO: 602 - DNA, 14 bp, Artificial sequence
  Synthetic oligonucleotide
taactactcctaat

SEQ ID NO: 603 - DNA, 14 bp, Artificial sequence
  Synthetic oligonucleotide
ataactactcctaa

SEQ ID NO: 604 - DNA, 14 bp, Artificial sequence
  Synthetic oligonucleotide
tataactactccta

SEQ ID NO: 605 - DNA, 14 bp, Artificial sequence
  Synthetic oligonucleotide
atataactactcct

SEQ ID NO: 606 - DNA, 14 bp, Artificial sequence
  Synthetic oligonucleotide
aatataactactcc

SEQ ID NO: 607 - DNA, 14 bp, Artificial sequence
  Synthetic oligonucleotide
aaatataactactc

SEQ ID NO: 608 - DNA, 14 bp, Artificial sequence
  Synthetic oligonucleotide
aaaatataactact

SEQ ID NO: 609 - DNA, 14 bp, Artificial sequence
  Synthetic oligonucleotide
aaaaatataactac

SEQ ID NO: 610 - DNA, 14 bp, Artificial sequence
  Synthetic oligonucleotide
taaaaatataacta

SEQ ID NO: 611 - DNA, 14 bp, Artificial sequence
  Synthetic oligonucleotide
gtaaaaatataact

SEQ ID NO: 612 - DNA, 14 bp, Artificial sequence
  Synthetic oligonucleotide
agtaaaaatataac

SEQ ID NO: 613 - DNA, 14 bp, Artificial sequence
  Synthetic oligonucleotide
actgatacccacaa

SEQ ID NO: 614 - DNA, 14 bp, Artificial sequence
  Synthetic oligonucleotide
aactgatacccaca

SEQ ID NO: 615 - DNA, 14 bp, Artificial sequence
  Synthetic oligonucleotide
caactgatacccac

SEQ ID NO: 616 - DNA, 14 bp, Artificial sequence
  Synthetic oligonucleotide
tcaactgataccca

SEQ ID NO: 617 - DNA, 14 bp, Artificial sequence
  Synthetic oligonucleotide
atcactaaaaaact

SEQ ID NO: 618 - DNA, 14 bp, Artificial sequence
  Synthetic oligonucleotide
tatcactaaaaaac

SEQ ID NO: 619 - DNA, 14 bp, Artificial sequence
  Synthetic oligonucleotide
atatcactaaaaaa

SEQ ID NO: 620 - DNA, 14 bp, Artificial sequence
  Synthetic oligonucleotide
tatatcactaaaaa

SEQ ID NO: 621 - DNA, 14 bp, Artificial sequence
  Synthetic oligonucleotide
ttatatcactaaaa

SEQ ID NO: 622 - DNA, 14 bp, Artificial sequence
  Synthetic oligonucleotide
tttatatcactaaa

SEQ ID NO: 623 - DNA, 14 bp, Artificial sequence
  Synthetic oligonucleotide
gtttatatcactaa

SEQ ID NO: 624 - DNA, 14 bp, Artificial sequence
  Synthetic oligonucleotide
aaacttttaattaa

SEQ ID NO: 625 - DNA, 14 bp, Artificial sequence
  Synthetic oligonucleotide
caaacttttaatta

SEQ ID NO: 626 - DNA, 14 bp, Artificial sequence
  Synthetic oligonucleotide
tcaaacttttaatt

SEQ ID NO: 627 - DNA, 14 bp, Artificial sequence
  Synthetic oligonucleotide
ttcaaacttttaat

SEQ ID NO: 628 - DNA, 14 bp, Artificial sequence
  Synthetic oligonucleotide
cttcaaacttttaa

SEQ ID NO: 629 - DNA, 14 bp, Artificial sequence
  Synthetic oligonucleotide
acttcaaactttta

SEQ ID NO: 630 - DNA, 14 bp, Artificial sequence
  Synthetic oligonucleotide
cacttcaaactttt

SEQ ID NO: 631 - DNA, 14 bp, Artificial sequence
  Synthetic oligonucleotide
ccacttcaaacttt

SEQ ID NO: 632 - DNA, 14 bp, Artificial sequence
  Synthetic oligonucleotide
cccacttcaaactt

SEQ ID NO: 633 - DNA, 14 bp, Artificial sequence
  Synthetic oligonucleotide
acccacttcaaact

SEQ ID NO: 634 - DNA, 14 bp, Artificial sequence
  Synthetic oligonucleotide
aacccacttcaaac

SEQ ID NO: 635 - DNA, 14 bp, Artificial sequence
  Synthetic oligonucleotide
aaacccacttcaaa

SEQ ID NO: 636 - DNA, 14 bp, Artificial sequence
  Synthetic oligonucleotide
aaaacccacttcaa

SEQ ID NO: 637 - DNA, 14 bp, Artificial sequence
  Synthetic oligonucleotide
aaaaacccacttca

SEQ ID NO: 638 - DNA, 14 bp, Artificial sequence
  Synthetic oligonucleotide
aaaaaacccacttc

SEQ ID NO: 639 - DNA, 14 bp, Artificial sequence
  Synthetic oligonucleotide
caaaaaacccactt

SEQ ID NO: 640 - DNA, 14 bp, Artificial sequence
  Synthetic oligonucleotide
acaaaaaacccact

SEQ ID NO: 641 - DNA, 14 bp, Artificial sequence
  Synthetic oligonucleotide
aacaaaaaacccac

SEQ ID NO: 642 - DNA, 14 bp, Artificial sequence
  Synthetic oligonucleotide
aaacaaaaaaccca

SEQ ID NO: 643 - DNA, 14 bp, Artificial sequence
  Synthetic oligonucleotide
aaaacaaaaaaccc

SEQ ID NO: 644 - DNA, 14 bp, Artificial sequence
  Synthetic oligonucleotide
atcttcccattaat

SEQ ID NO: 645 - DNA, 14 bp, Artificial sequence
  Synthetic oligonucleotide
aatcttcccattaa

SEQ ID NO: 646 - DNA, 14 bp, Artificial sequence
  Synthetic oligonucleotide
taatcttcccatta

SEQ ID NO: 647 - DNA, 14 bp, Artificial sequence
  Synthetic oligonucleotide
ataatcttcccatt

SEQ ID NO: 648 - DNA, 14 bp, Artificial sequence
  Synthetic oligonucleotide
aataatcttcccat

SEQ ID NO: 649 - DNA, 14 bp, Artificial sequence
  Synthetic oligonucleotide
aaataatcttccca

SEQ ID NO: 650 - DNA, 14 bp, Artificial sequence
  Synthetic oligonucleotide
aaaataatcttccc

SEQ ID NO: 651 - DNA, 14 bp, Artificial sequence
  Synthetic oligonucleotide
tattaatcaaaaat

SEQ ID NO: 652 - DNA, 14 bp, Artificial sequence
  Synthetic oligonucleotide
ctattaatcaaaaa

SEQ ID NO: 653 - DNA, 14 bp, Artificial sequence
  Synthetic oligonucleotide
tctattaatcaaaa

SEQ ID NO: 654 - DNA, 14 bp, Artificial sequence
  Synthetic oligonucleotide
ctctattaatcaaa

SEQ ID NO: 655 - DNA, 14 bp, Artificial sequence
  Synthetic oligonucleotide
actctattaatcaa

SEQ ID NO: 656 - DNA, 14 bp, Artificial sequence
  Synthetic oligonucleotide
gactctattaatca

SEQ ID NO: 657 - DNA, 14 bp, Artificial sequence
  Synthetic oligonucleotide
tattctactcttct

SEQ ID NO: 658 - DNA, 14 bp, Artificial sequence
  Synthetic oligonucleotide
atattctactcttc

SEQ ID NO: 659 - DNA, 14 bp, Artificial sequence
  Synthetic oligonucleotide
aatattctactctt

SEQ ID NO: 660 - DNA, 14 bp, Artificial sequence
  Synthetic oligonucleotide
gaatattctactct

SEQ ID NO: 661 - DNA, 14 bp, Artificial sequence
  Synthetic oligonucleotide
agaatattctactc

SEQ ID NO: 662 - DNA, 14 bp, Artificial sequence
  Synthetic oligonucleotide
atttaccaattcaa

SEQ ID NO: 663 - DNA, 14 bp, Artificial sequence
  Synthetic oligonucleotide
tatttaccaattca

SEQ ID NO: 664 - DNA, 14 bp, Artificial sequence
  Synthetic oligonucleotide
gtatttaccaattc

SEQ ID NO: 665 - DNA, 14 bp, Artificial sequence
  Synthetic oligonucleotide
tgtatttaccaatt

SEQ ID NO: 666 - DNA, 14 bp, Artificial sequence
  Synthetic oligonucleotide
ctgtatttaccaat

SEQ ID NO: 667 - DNA, 14 bp, Artificial sequence
  Synthetic oligonucleotide
actgtatttaccaa

SEQ ID NO: 668 - DNA, 14 bp, Artificial sequence
  Synthetic oligonucleotide
ttataccatcaaat

SEQ ID NO: 669 - DNA, 14 bp, Artificial sequence
  Synthetic oligonucleotide
attataccatcaaa

SEQ ID NO: 670 - DNA, 14 bp, Artificial sequence
  Synthetic oligonucleotide
cattataccatcaa

SEQ ID NO: 671 - DNA, 14 bp, Artificial sequence
  Synthetic oligonucleotide
tcattataccatca

SEQ ID NO: 672 - DNA, 14 bp, Artificial sequence
  Synthetic oligonucleotide
ttcattataccatc

SEQ ID NO: 673 - DNA, 14 bp, Artificial sequence
  Synthetic oligonucleotide
cttcattataccat

SEQ ID NO: 674 - DNA, 14 bp, Artificial sequence
  Synthetic oligonucleotide
tcttcattatacca

SEQ ID NO: 675 - DNA, 14 bp, Artificial sequence
  Synthetic oligonucleotide
ttcttcattatacc

SEQ ID NO: 676 - DNA, 14 bp, Artificial sequence
  Synthetic oligonucleotide
tttcttcattatac

SEQ ID NO: 677 - DNA, 14 bp, Artificial sequence
  Synthetic oligonucleotide
ttttcttcattata

SEQ ID NO: 678 - DNA, 14 bp, Artificial sequence
  Synthetic oligonucleotide
attttcttcattat

SEQ ID NO: 679 - DNA, 14 bp, Artificial sequence
  Synthetic oligonucleotide
tattttcttcatta

SEQ ID NO: 680 - DNA, 14 bp, Artificial sequence
  Synthetic oligonucleotide
atattttcttcatt

SEQ ID NO: 681 - DNA, 14 bp, Artificial sequence
  Synthetic oligonucleotide
aatattttcttcat

SEQ ID NO: 682 - DNA, 14 bp, Artificial sequence
  Synthetic oligonucleotide
aaatattttcttca

SEQ ID NO: 683 - DNA, 14 bp, Artificial sequence
  Synthetic oligonucleotide
taaatattttcttc

SEQ ID NO: 684 - DNA, 14 bp, Artificial sequence
  Synthetic oligonucleotide
aataatccaaactt

SEQ ID NO: 685 - DNA, 14 bp, Artificial sequence
  Synthetic oligonucleotide
aaataatccaaact

SEQ ID NO: 686 - DNA, 14 bp, Artificial sequence
  Synthetic oligonucleotide
aaaataatccaaac

SEQ ID NO: 687 - DNA, 14 bp, Artificial sequence
  Synthetic oligonucleotide
caaaataatccaaa

SEQ ID NO: 688 - DNA, 14 bp, Artificial sequence
  Synthetic oligonucleotide
acaaaataatccaa

SEQ ID NO: 689 - DNA, 14 bp, Artificial sequence
  Synthetic oligonucleotide
tacaaaataatcca

SEQ ID NO: 690 - DNA, 14 bp, Artificial sequence
  Synthetic oligonucleotide
ttacaaaataatcc

SEQ ID NO: 691 - DNA, 14 bp, Artificial sequence
  Synthetic oligonucleotide
gttacaaaataatc

SEQ ID NO: 692 - DNA, 14 bp, Artificial sequence
  Synthetic oligonucleotide
tgttacaaaataat

SEQ ID NO: 693 - DNA, 14 bp, Artificial sequence
  Synthetic oligonucleotide
ttttacattaacta

SEQ ID NO: 694 - DNA, 14 bp, Artificial sequence
  Synthetic oligonucleotide
tttttacattaact

SEQ ID NO: 695 - DNA, 14 bp, Artificial sequence
  Synthetic oligonucleotide
ttttttacattaac

SEQ ID NO: 696 - DNA, 14 bp, Artificial sequence
  Synthetic oligonucleotide
attttttacattaa

SEQ ID NO: 697 - DNA, 14 bp, Artificial sequence
  Synthetic oligonucleotide
tattttttacatta

SEQ ID NO: 698 - DNA, 14 bp, Artificial sequence
  Synthetic oligonucleotide
ttattttttacatt

SEQ ID NO: 699 - DNA, 14 bp, Artificial sequence
  Synthetic oligonucleotide
aaatactaacatca

SEQ ID NO: 700 - DNA, 14 bp, Artificial sequence
  Synthetic oligonucleotide
aaaatactaacatc

SEQ ID NO: 701 - DNA, 14 bp, Artificial sequence
  Synthetic oligonucleotide
caaaatactaacat

SEQ ID NO: 702 - DNA, 14 bp, Artificial sequence
  Synthetic oligonucleotide
ccaaaatactaaca

SEQ ID NO: 703 - DNA, 14 bp, Artificial sequence
  Synthetic oligonucleotide
gccaaaatactaac

SEQ ID NO: 704 - DNA, 14 bp, Artificial sequence
  Synthetic oligonucleotide
tgccaaaatactaa

SEQ ID NO: 705 - DNA, 14 bp, Artificial sequence
  Synthetic oligonucleotide
tccattcattttat

SEQ ID NO: 706 - DNA, 14 bp, Artificial sequence
  Synthetic oligonucleotide
atccattcatttta

SEQ ID NO: 707 - DNA, 14 bp, Artificial sequence
  Synthetic oligonucleotide
catccattcatttt

SEQ ID NO: 708 - DNA, 14 bp, Artificial sequence
  Synthetic oligonucleotide
acatccattcattt

SEQ ID NO: 709 - DNA, 14 bp, Artificial sequence
  Synthetic oligonucleotide
cacatccattcatt

SEQ ID NO: 710 - DNA, 14 bp, Artificial sequence
  Synthetic oligonucleotide
ccacatccattcat

SEQ ID NO: 711 - DNA, 14 bp, Artificial sequence
  Synthetic oligonucleotide
gccacatccattca

SEQ ID NO: 712 - DNA, 14 bp, Artificial sequence
  Synthetic oligonucleotide
tgccacatccattc

SEQ ID NO: 713 - DNA, 14 bp, Artificial sequence
  Synthetic oligonucleotide
atgccacatccatt

SEQ ID NO: 714 - DNA, 14 bp, Artificial sequence
  Synthetic oligonucleotide
tatgccacatccat

SEQ ID NO: 715 - DNA, 14 bp, Artificial sequence
  Synthetic oligonucleotide
ttatgccacatcca

SEQ ID NO: 716 - DNA, 14 bp, Artificial sequence
  Synthetic oligonucleotide
attatgccacatcc

SEQ ID NO: 717 - DNA, 14 bp, Artificial sequence
  Synthetic oligonucleotide
tcttaactcttctc

SEQ ID NO: 718 - DNA, 14 bp, Artificial sequence
  Synthetic oligonucleotide
ttcttaactcttct

SEQ ID NO: 719 - DNA, 14 bp, Artificial sequence
  Synthetic oligonucleotide
gttcttaactcttc

SEQ ID NO: 720 - DNA, 14 bp, Artificial sequence
  Synthetic oligonucleotide
agttcttaactctt

SEQ ID NO: 721 - DNA, 14 bp, Artificial sequence
  Synthetic oligonucleotide
tagttcttaactct

SEQ ID NO: 722 - DNA, 14 bp, Artificial sequence
  Synthetic oligonucleotide
caaatactcaaaaa

SEQ ID NO: 723 - DNA, 14 bp, Artificial sequence
  Synthetic oligonucleotide
tcaaatactcaaaa

SEQ ID NO: 724 - DNA, 14 bp, Artificial sequence
  Synthetic oligonucleotide
ttcaaatactcaaa

SEQ ID NO: 725 - DNA, 14 bp, Artificial sequence
  Synthetic oligonucleotide
cttcaaatactcaa

SEQ ID NO: 726 - DNA, 14 bp, Artificial sequence
  Synthetic oligonucleotide
gcttcaaatactca

SEQ ID NO: 727 - DNA, 14 bp, Artificial sequence
  Synthetic oligonucleotide
agcttcaaatactc

SEQ ID NO: 728 - DNA, 14 bp, Artificial sequence
  Synthetic oligonucleotide
aagcttcaaatact

SEQ ID NO: 729 - DNA, 14 bp, Artificial sequence
  Synthetic oligonucleotide
cctcattacccatt

SEQ ID NO: 730 - DNA, 14 bp, Artificial sequence
  Synthetic oligonucleotide
tcctcattacccat

SEQ ID NO: 731 - DNA, 14 bp, Artificial sequence
  Synthetic oligonucleotide
atcctcattaccca

SEQ ID NO: 732 - DNA, 14 bp, Artificial sequence
  Synthetic oligonucleotide
tatcctcattaccc

SEQ ID NO: 733 - DNA, 14 bp, Artificial sequence
  Synthetic oligonucleotide
atatcctcattacc

SEQ ID NO: 734 - DNA, 14 bp, Artificial sequence
  Synthetic oligonucleotide
aatatcctcattac

SEQ ID NO: 735 - DNA, 14 bp, Artificial sequence
  Synthetic oligonucleotide
taatatcctcatta

SEQ ID NO: 736 - DNA, 14 bp, Artificial sequence
  Synthetic oligonucleotide
ttaatatcctcatt

SEQ ID NO: 737 - DNA, 14 bp, Artificial sequence
  Synthetic oligonucleotide
tttaatatcctcat

SEQ ID NO: 738 - DNA, 14 bp, Artificial sequence
  Synthetic oligonucleotide
atttaatatcctca

SEQ ID NO: 739 - DNA, 14 bp, Artificial sequence
  Synthetic oligonucleotide
aatttaatatcctc

SEQ ID NO: 740 - DNA, 14 bp, Artificial sequence
  Synthetic oligonucleotide
aaatttaatatcct

SEQ ID NO: 741 - DNA, 14 bp, Artificial sequence
  Synthetic oligonucleotide
taaatttaatatcc

SEQ ID NO: 742 - DNA, 14 bp, Artificial sequence
  Synthetic oligonucleotide
ttaaatttaatatc

SEQ ID NO: 743 - DNA, 14 bp, Artificial sequence
  Synthetic oligonucleotide
cttaaatttaatat

SEQ ID NO: 744 - DNA, 14 bp, Artificial sequence
  Synthetic oligonucleotide
tcttaaatttaata

SEQ ID NO: 745 - DNA, 14 bp, Artificial sequence
  Synthetic oligonucleotide
ttcttaaatttaat

SEQ ID NO: 746 - DNA, 14 bp, Artificial sequence
  Synthetic oligonucleotide
gttcttaaatttaa

SEQ ID NO: 747 - DNA, 14 bp, Artificial sequence
  Synthetic oligonucleotide
ttattctactttta

SEQ ID NO: 748 - DNA, 14 bp, Artificial sequence
  Synthetic oligonucleotide
tttattctactttt

SEQ ID NO: 749 - DNA, 14 bp, Artificial sequence
  Synthetic oligonucleotide
ctttattctacttt

SEQ ID NO: 750 - DNA, 14 bp, Artificial sequence
  Synthetic oligonucleotide
cctttattctactt

SEQ ID NO: 751 - DNA, 14 bp, Artificial sequence
  Synthetic oligonucleotide
gcctttattctact

SEQ ID NO: 752 - DNA, 14 bp, Artificial sequence
  Synthetic oligonucleotide
aacaattattaata

SEQ ID NO: 753 - DNA, 14 bp, Artificial sequence
  Synthetic oligonucleotide
caacaattattaat

SEQ ID NO: 754 - DNA, 14 bp, Artificial sequence
  Synthetic oligonucleotide
gcaacaattattaa

SEQ ID NO: 755 - DNA, 14 bp, Artificial sequence
  Synthetic oligonucleotide
agcaacaattatta

SEQ ID NO: 756 - DNA, 14 bp, Artificial sequence
  Synthetic oligonucleotide
cagcaacaattatt

SEQ ID NO: 757 - DNA, 14 bp, Artificial sequence
  Synthetic oligonucleotide
ccagcaacaattat

SEQ ID NO: 758 - DNA, 14 bp, Artificial sequence
  Synthetic oligonucleotide
accagcaacaatta

SEQ ID NO: 759 - DNA, 14 bp, Artificial sequence
  Synthetic oligonucleotide
aaaccaaaacttac

SEQ ID NO: 760 - DNA, 14 bp, Artificial sequence
  Synthetic oligonucleotide
aaaaccaaaactta

SEQ ID NO: 761 - DNA, 14 bp, Artificial sequence
  Synthetic oligonucleotide
aaaaaccaaaactt

SEQ ID NO: 762 - DNA, 14 bp, Artificial sequence
  Synthetic oligonucleotide
caaaaaccaaaact

SEQ ID NO: 763 - DNA, 14 bp, Artificial sequence
  Synthetic oligonucleotide
ccaaaaaccaaaac

SEQ ID NO: 764 - DNA, 14 bp, Artificial sequence
  Synthetic oligonucleotide
accaaaaaccaaaa

SEQ ID NO: 765 - DNA, 14 bp, Artificial sequence
  Synthetic oligonucleotide
aaccaaaaaccaaa

SEQ ID NO: 766 - DNA, 14 bp, Artificial sequence
  Synthetic oligonucleotide
aaaccaaaaaccaa

SEQ ID NO: 767 - DNA, 14 bp, Artificial sequence
  Synthetic oligonucleotide
atctaaaacacttc

SEQ ID NO: 768 - DNA, 14 bp, Artificial sequence
  Synthetic oligonucleotide
aatctaaaacactt

SEQ ID NO: 769 - DNA, 14 bp, Artificial sequence
  Synthetic oligonucleotide
aaatctaaaacact

SEQ ID NO: 770 - DNA, 14 bp, Artificial sequence
  Synthetic oligonucleotide
caaatctaaaacac

SEQ ID NO: 771 - DNA, 14 bp, Artificial sequence
  Synthetic oligonucleotide
ccaaatctaaaaca

SEQ ID NO: 772 - DNA, 14 bp, Artificial sequence
  Synthetic oligonucleotide
cccaaatctaaaac

SEQ ID NO: 773 - DNA, 14 bp, Artificial sequence
  Synthetic oligonucleotide
ccccaaatctaaaa

SEQ ID NO: 774 - DNA, 14 bp, Artificial sequence
  Synthetic oligonucleotide
accccaaatctaaa

SEQ ID NO: 775 - DNA, 14 bp, Artificial sequence
  Synthetic oligonucleotide
aaccccaaatctaa

SEQ ID NO: 776 - DNA, 14 bp, Artificial sequence
  Synthetic oligonucleotide
aaaccccaaatcta

SEQ ID NO: 777 - DNA, 14 bp, Artificial sequence
  Synthetic oligonucleotide
attcacaaatccta

SEQ ID NO: 778 - DNA, 14 bp, Artificial sequence
  Synthetic oligonucleotide
tattcacaaatcct

SEQ ID NO: 779 - DNA, 14 bp, Artificial sequence
  Synthetic oligonucleotide
atattcacaaatcc

SEQ ID NO: 780 - DNA, 14 bp, Artificial sequence
  Synthetic oligonucleotide
aatattcacaaatc

SEQ ID NO: 781 - DNA, 14 bp, Artificial sequence
  Synthetic oligonucleotide
aaatattcacaaat

SEQ ID NO: 782 - DNA, 14 bp, Artificial sequence
  Synthetic oligonucleotide
caaatattcacaaa

SEQ ID NO: 783 - DNA, 14 bp, Artificial sequence
  Synthetic oligonucleotide
gcaaatattcacaa

SEQ ID NO: 784 - DNA, 14 bp, Artificial sequence
  Synthetic oligonucleotide
aacacacattatca

SEQ ID NO: 785 - DNA, 14 bp, Artificial sequence
  Synthetic oligonucleotide
taacacacattatc

SEQ ID NO: 786 - DNA, 14 bp, Artificial sequence
  Synthetic oligonucleotide
ttaacacacattat

SEQ ID NO: 787 - DNA, 14 bp, Artificial sequence
  Synthetic oligonucleotide
tttaacacacatta

SEQ ID NO: 788 - DNA, 14 bp, Artificial sequence
  Synthetic oligonucleotide
atttaacacacatt

SEQ ID NO: 789 - DNA, 14 bp, Artificial sequence
  Synthetic oligonucleotide
tatttaacacacat

SEQ ID NO: 790 - DNA, 14 bp, Artificial sequence
  Synthetic oligonucleotide
ctatttaacacaca

SEQ ID NO: 791 - DNA, 14 bp, Artificial sequence
  Synthetic oligonucleotide
actatttaacacac

SEQ ID NO: 792 - DNA, 14 bp, Artificial sequence
  Synthetic oligonucleotide
tactatttaacaca

SEQ ID NO: 793 - DNA, 14 bp, Artificial sequence
  Synthetic oligonucleotide
ctactatttaacac

SEQ ID NO: 794 - DNA, 14 bp, Artificial sequence
  Synthetic oligonucleotide
actactatttaaca

SEQ ID NO: 795 - DNA, 14 bp, Artificial sequence
  Synthetic oligonucleotide
aactactatttaac

SEQ ID NO: 796 - DNA, 14 bp, Artificial sequence
  Synthetic oligonucleotide
aaactactatttaa

SEQ ID NO: 797 - DNA, 14 bp, Artificial sequence
  Synthetic oligonucleotide
aaaactactattta

SEQ ID NO: 798 - DNA, 14 bp, Artificial sequence
  Synthetic oligonucleotide
gaaaactactattt

SEQ ID NO: 799 - DNA, 14 bp, Artificial sequence
  Synthetic oligonucleotide
tgaaaactactatt

SEQ ID NO: 800 - DNA, 14 bp, Artificial sequence
  Synthetic oligonucleotide
aaataacctatcat

SEQ ID NO: 801 - DNA, 14 bp, Artificial sequence
  Synthetic oligonucleotide
aaaataacctatca

SEQ ID NO: 802 - DNA, 14 bp, Artificial sequence
  Synthetic oligonucleotide
caaaataacctatc

SEQ ID NO: 803 - DNA, 14 bp, Artificial sequence
  Synthetic oligonucleotide
acaaaataacctat

SEQ ID NO: 804 - DNA, 14 bp, Artificial sequence
  Synthetic oligonucleotide
cacaaaataaccta

SEQ ID NO: 805 - DNA, 14 bp, Artificial sequence
  Synthetic oligonucleotide
tcacaaaataacct

SEQ ID NO: 806 - DNA, 14 bp, Artificial sequence
  Synthetic oligonucleotide
atcacaaaataacc

SEQ ID NO: 807 - DNA, 14 bp, Artificial sequence
  Synthetic oligonucleotide
catcacaaaataac

SEQ ID NO: 808 - DNA, 14 bp, Artificial sequence
  Synthetic oligonucleotide
tcatcacaaaataa

SEQ ID NO: 809 - DNA, 14 bp, Artificial sequence
  Synthetic oligonucleotide
ttcatcacaaaata

SEQ ID NO: 810 - DNA, 14 bp, Artificial sequence
  Synthetic oligonucleotide
tttcatcacaaaat

SEQ ID NO: 811 - DNA, 14 bp, Artificial sequence
  Synthetic oligonucleotide
ttttcatcacaaaa

SEQ ID NO: 812 - DNA, 14 bp, Artificial sequence
  Synthetic oligonucleotide
attttcatcacaaa

SEQ ID NO: 813 - DNA, 14 bp, Artificial sequence
  Synthetic oligonucleotide
tattttcatcacaa

SEQ ID NO: 814 - DNA, 14 bp, Artificial sequence
  Synthetic oligonucleotide
gtattttcatcaca

SEQ ID NO: 815 - DNA, 14 bp, Artificial sequence
  Synthetic oligonucleotide
atttaaatttatca

SEQ ID NO: 816 - DNA, 14 bp, Artificial sequence
  Synthetic oligonucleotide
aatttaaatttatc

SEQ ID NO: 817 - DNA, 14 bp, Artificial sequence
  Synthetic oligonucleotide
aaatttaaatttat

SEQ ID NO: 818 - DNA, 14 bp, Artificial sequence
  Synthetic oligonucleotide
aaaatttaaattta

SEQ ID NO: 819 - DNA, 14 bp, Artificial sequence
  Synthetic oligonucleotide
taaaatttaaattt

SEQ ID NO: 820 - DNA, 14 bp, Artificial sequence
  Synthetic oligonucleotide
ataaaatttaaatt

SEQ ID NO: 821 - DNA, 14 bp, Artificial sequence
  Synthetic oligonucleotide
cataaaatttaaat

SEQ ID NO: 822 - DNA, 14 bp, Artificial sequence
  Synthetic oligonucleotide
acataaaatttaaa

SEQ ID NO: 823 - DNA, 14 bp, Artificial sequence
  Synthetic oligonucleotide
ctactaatattcat

SEQ ID NO: 824 - DNA, 14 bp, Artificial sequence
  Synthetic oligonucleotide
cctactaatattca

SEQ ID NO: 825 - DNA, 14 bp, Artificial sequence
  Synthetic oligonucleotide
acctactaatattc

SEQ ID NO: 826 - DNA, 14 bp, Artificial sequence
  Synthetic oligonucleotide
cacctactaatatt

SEQ ID NO: 827 - DNA, 14 bp, Artificial sequence
  Synthetic oligonucleotide
tcacctactaatat

SEQ ID NO: 828 - DNA, 14 bp, Artificial sequence
  Synthetic oligonucleotide
ttcacctactaata

SEQ ID NO: 829 - DNA, 14 bp, Artificial sequence
  Synthetic oligonucleotide
tttcacctactaat

SEQ ID NO: 830 - DNA, 14 bp, Artificial sequence
  Synthetic oligonucleotide
ttttcacctactaa

SEQ ID NO: 831 - DNA, 14 bp, Artificial sequence
  Synthetic oligonucleotide
tttttcacctacta

SEQ ID NO: 832 - DNA, 14 bp, Artificial sequence
  Synthetic oligonucleotide
atttttcacctact

SEQ ID NO: 833 - DNA, 14 bp, Artificial sequence
  Synthetic oligonucleotide
tatttttcacctac

SEQ ID NO: 834 - DNA, 14 bp, Artificial sequence
  Synthetic oligonucleotide
ttatttttcaccta

SEQ ID NO: 835 - DNA, 14 bp, Artificial sequence
  Synthetic oligonucleotide
tttatttttcacct

SEQ ID NO: 836 - DNA, 14 bp, Artificial sequence
  Synthetic oligonucleotide
ttctactactaatt

SEQ ID NO: 837 - DNA, 14 bp, Artificial sequence
  Synthetic oligonucleotide
cttctactactaat

SEQ ID NO: 838 - DNA, 14 bp, Artificial sequence
  Synthetic oligonucleotide
acttctactactaa

SEQ ID NO: 839 - DNA, 14 bp, Artificial sequence
  Synthetic oligonucleotide
aacttctactacta

SEQ ID NO: 840 - DNA, 14 bp, Artificial sequence
  Synthetic oligonucleotide
caacttctactact

SEQ ID NO: 841 - DNA, 14 bp, Artificial sequence
  Synthetic oligonucleotide
tcaacttctactac

SEQ ID NO: 842 - DNA, 14 bp, Artificial sequence
  Synthetic oligonucleotide
ctcaacttctacta

SEQ ID NO: 843 - DNA, 14 bp, Artificial sequence
  Synthetic oligonucleotide
tctcaacttctact

SEQ ID NO: 844 - DNA, 14 bp, Artificial sequence
  Synthetic oligonucleotide
ctctcaacttctac

SEQ ID NO: 845 - DNA, 14 bp, Artificial sequence
  Synthetic oligonucleotide
tctctcaacttcta

SEQ ID NO: 846 - DNA, 14 bp, Artificial sequence
  Synthetic oligonucleotide
ttctctcaacttct

SEQ ID NO: 847 - DNA, 14 bp, Artificial sequence
  Synthetic oligonucleotide
tttctctcaacttc

SEQ ID NO: 848 - DNA, 14 bp, Artificial sequence
  Synthetic oligonucleotide
ttttctctcaactt

SEQ ID NO: 849 - DNA, 14 bp, Artificial sequence
  Synthetic oligonucleotide
tttttctctcaact

SEQ ID NO: 850 - DNA, 14 bp, Artificial sequence
  Synthetic oligonucleotide
ctttttctctcaac

SEQ ID NO: 851 - DNA, 14 bp, Artificial sequence
  Synthetic oligonucleotide
actttttctctcaa

SEQ ID NO: 852 - DNA, 14 bp, Artificial sequence
  Synthetic oligonucleotide
tactttttctctca

SEQ ID NO: 853 - DNA, 14 bp, Artificial sequence
  Synthetic oligonucleotide
ttactttttctctc

SEQ ID NO: 854 - DNA, 14 bp, Artificial sequence
  Synthetic oligonucleotide
gttactttttctct

SEQ ID NO: 855 - DNA, 14 bp, Artificial sequence
  Synthetic oligonucleotide
agttactttttctc

SEQ ID NO: 856 - DNA, 14 bp, Artificial sequence
  Synthetic oligonucleotide
cattcccattaaca

SEQ ID NO: 857 - DNA, 14 bp, Artificial sequence
  Synthetic oligonucleotide
acattcccattaac

SEQ ID NO: 858 - DNA, 14 bp, Artificial sequence
  Synthetic oligonucleotide
tacattcccattaa

SEQ ID NO: 859 - DNA, 14 bp, Artificial sequence
  Synthetic oligonucleotide
ttacattcccatta

SEQ ID NO: 860 - DNA, 14 bp, Artificial sequence
  Synthetic oligonucleotide
tttacattcccatt

SEQ ID NO: 861 - DNA, 14 bp, Artificial sequence
  Synthetic oligonucleotide
ttttacattcccat

SEQ ID NO: 862 - DNA, 14 bp, Artificial sequence
  Synthetic oligonucleotide
cttttacattccca

SEQ ID NO: 863 - DNA, 14 bp, Artificial sequence
  Synthetic oligonucleotide
acttttacattccc

SEQ ID NO: 864 - DNA, 14 bp, Artificial sequence
  Synthetic oligonucleotide
cacttttacattcc

SEQ ID NO: 865 - DNA, 14 bp, Artificial sequence
  Synthetic oligonucleotide
acacttttacattc

SEQ ID NO: 866 - DNA, 14 bp, Artificial sequence
  Synthetic oligonucleotide
tacacttttacatt

SEQ ID NO: 867 - DNA, 14 bp, Artificial sequence
  Synthetic oligonucleotide
gtacacttttacat

SEQ ID NO: 868 - DNA, 14 bp, Artificial sequence
  Synthetic oligonucleotide
tgtacacttttaca

SEQ ID NO: 869 - DNA, 14 bp, Artificial sequence
  Synthetic oligonucleotide
tttatcaaaaaaat

SEQ ID NO: 870 - DNA, 14 bp, Artificial sequence
  Synthetic oligonucleotide
atttatcaaaaaaa

SEQ ID NO: 871 - DNA, 14 bp, Artificial sequence
  Synthetic oligonucleotide
catttatcaaaaaa

SEQ ID NO: 872 - DNA, 14 bp, Artificial sequence
  Synthetic oligonucleotide
acatttatcaaaaa

SEQ ID NO: 873 - DNA, 14 bp, Artificial sequence
  Synthetic oligonucleotide
tacatttatcaaaa

SEQ ID NO: 874 - DNA, 14 bp, Artificial sequence
  Synthetic oligonucleotide
atacatttatcaaa

SEQ ID NO: 875 - DNA, 14 bp, Artificial sequence
  Synthetic oligonucleotide
tatacatttatcaa

SEQ ID NO: 876 - DNA, 14 bp, Artificial sequence
  Synthetic oligonucleotide
acatcttccaattt

SEQ ID NO: 877 - DNA, 14 bp, Artificial sequence
  Synthetic oligonucleotide
tacatcttccaatt

SEQ ID NO: 878 - DNA, 14 bp, Artificial sequence
  Synthetic oligonucleotide
ttacatcttccaat

SEQ ID NO: 879 - DNA, 14 bp, Artificial sequence
  Synthetic oligonucleotide
tttacatcttccaa

SEQ ID NO: 880 - DNA, 14 bp, Artificial sequence
  Synthetic oligonucleotide
atttacatcttcca

SEQ ID NO: 881 - DNA, 14 bp, Artificial sequence
  Synthetic oligonucleotide
tatttacatcttcc

SEQ ID NO: 882 - DNA, 14 bp, Artificial sequence
  Synthetic oligonucleotide
ttatttacatcttc

SEQ ID NO: 883 - DNA, 14 bp, Artificial sequence
  Synthetic oligonucleotide
cttatttacatctt

SEQ ID NO: 884 - DNA, 14 bp, Artificial sequence
  Synthetic oligonucleotide
tcttatttacatct

SEQ ID NO: 885 - DNA, 14 bp, Artificial sequence
  Synthetic oligonucleotide
atcttatttacatc

SEQ ID NO: 886 - DNA, 14 bp, Artificial sequence
  Synthetic oligonucleotide
aatcttatttacat

SEQ ID NO: 887 - DNA, 14 bp, Artificial sequence
  Synthetic oligonucleotide
gaatcttatttaca

SEQ ID NO: 888 - DNA, 14 bp, Artificial sequence
  Synthetic oligonucleotide
tgaatcttatttac

SEQ ID NO: 889 - DNA, 14 bp, Artificial sequence
  Synthetic oligonucleotide
ttcccttcactcct

SEQ ID NO: 890 - DNA, 14 bp, Artificial sequence
  Synthetic oligonucleotide
tttcccttcactcc

SEQ ID NO: 891 - DNA, 14 bp, Artificial sequence
  Synthetic oligonucleotide
ttttcccttcactc

SEQ ID NO: 892 - DNA, 14 bp, Artificial sequence
  Synthetic oligonucleotide
attttcccttcact

SEQ ID NO: 893 - DNA, 14 bp, Artificial sequence
  Synthetic oligonucleotide
aattttcccttcac

SEQ ID NO: 894 - DNA, 14 bp, Artificial sequence
  Synthetic oligonucleotide
taattttcccttca

SEQ ID NO: 895 - DNA, 14 bp, Artificial sequence
  Synthetic oligonucleotide
ttaattttcccttc

SEQ ID NO: 896 - DNA, 14 bp, Artificial sequence
  Synthetic oligonucleotide
gttaattttccctt

SEQ ID NO: 897 - DNA, 14 bp, Artificial sequence
  Synthetic oligonucleotide
tttatcatttcttt

SEQ ID NO: 898 - DNA, 14 bp, Artificial sequence
  Synthetic oligonucleotide
ttttatcatttctt

SEQ ID NO: 899 - DNA, 14 bp, Artificial sequence
  Synthetic oligonucleotide
cttttatcatttct

SEQ ID NO: 900 - DNA, 14 bp, Artificial sequence
  Synthetic oligonucleotide
tcttttatcatttc

SEQ ID NO: 901 - DNA, 14 bp, Artificial sequence
  Synthetic oligonucleotide
ttcttttatcattt

SEQ ID NO: 902 - DNA, 14 bp, Artificial sequence
  Synthetic oligonucleotide
cttcttttatcatt

SEQ ID NO: 903 - DNA, 14 bp, Artificial sequence
  Synthetic oligonucleotide
acttcttttatcat

SEQ ID NO: 904 - DNA, 14 bp, Artificial sequence
  Synthetic oligonucleotide
tacttcttttatca

SEQ ID NO: 905 - DNA, 14 bp, Artificial sequence
  Synthetic oligonucleotide
ttacttcttttatc

SEQ ID NO: 906 - DNA, 14 bp, Artificial sequence
  Synthetic oligonucleotide
attacttcttttat

SEQ ID NO: 907 - DNA, 14 bp, Artificial sequence
  Synthetic oligonucleotide
aattacttctttta

SEQ ID NO: 908 - DNA, 14 bp, Artificial sequence
  Synthetic oligonucleotide
aaattacttctttt

SEQ ID NO: 909 - DNA, 14 bp, Artificial sequence
  Synthetic oligonucleotide
aaaattacttcttt

SEQ ID NO: 910 - DNA, 14 bp, Artificial sequence
  Synthetic oligonucleotide
caaaattacttctt

SEQ ID NO: 911 - DNA, 14 bp, Artificial sequence
  Synthetic oligonucleotide
ccaaaattacttct

SEQ ID NO: 912 - DNA, 14 bp, Artificial sequence
  Synthetic oligonucleotide
tccaaaattacttc

SEQ ID NO: 913 - DNA, 14 bp, Artificial sequence
  Synthetic oligonucleotide
ttccaaaattactt

SEQ ID NO: 914 - DNA, 14 bp, Artificial sequence
  Synthetic oligonucleotide
gttccaaaattact

SEQ ID NO: 915 - DNA, 14 bp, Artificial sequence
  Synthetic oligonucleotide
tgttccaaaattac

SEQ ID NO: 916 - DNA, 14 bp, Artificial sequence
  Synthetic oligonucleotide
atgttccaaaatta

SEQ ID NO: 917 - DNA, 14 bp, Artificial sequence
  Synthetic oligonucleotide
ttactctttttatt

SEQ ID NO: 918 - DNA, 14 bp, Artificial sequence
  Synthetic oligonucleotide
tttactctttttat

SEQ ID NO: 919 - DNA, 14 bp, Artificial sequence
  Synthetic oligonucleotide
ttttactcttttta

SEQ ID NO: 920 - DNA, 14 bp, Artificial sequence
  Synthetic oligonucleotide
attttactcttttt

SEQ ID NO: 921 - DNA, 14 bp, Artificial sequence
  Synthetic oligonucleotide
tattttactctttt

SEQ ID NO: 922 - DNA, 14 bp, Artificial sequence
  Synthetic oligonucleotide
atattttactcttt

SEQ ID NO: 923 - DNA, 14 bp, Artificial sequence
  Synthetic oligonucleotide
catattttactctt

SEQ ID NO: 924 - DNA, 14 bp, Artificial sequence
  Synthetic oligonucleotide
ccatattttactct

SEQ ID NO: 925 - DNA, 14 bp, Artificial sequence
  Synthetic oligonucleotide
cccatattttactc

SEQ ID NO: 926 - DNA, 14 bp, Artificial sequence
  Synthetic oligonucleotide
acccatattttact

SEQ ID NO: 927 - DNA, 14 bp, Artificial sequence
  Synthetic oligonucleotide
tacccatattttac

SEQ ID NO: 928 - DNA, 14 bp, Artificial sequence
  Synthetic oligonucleotide
ttacccatatttta

SEQ ID NO: 929 - DNA, 14 bp, Artificial sequence
  Synthetic oligonucleotide
tttacccatatttt

SEQ ID NO: 930 - DNA, 14 bp, Artificial sequence
  Synthetic oligonucleotide
gtttacccatattt

SEQ ID NO: 931 - DNA, 14 bp, Artificial sequence
  Synthetic oligonucleotide
tgtttacccatatt

SEQ ID NO: 932 - DNA, 14 bp, Artificial sequence
  Synthetic oligonucleotide
gttacctcccttta

SEQ ID NO: 933 - DNA, 14 bp, Artificial sequence
  Synthetic oligonucleotide
ggttacctcccttt

SEQ ID NO: 934 - DNA, 14 bp, Artificial sequence
  Synthetic oligonucleotide
aggttacctccctt

SEQ ID NO: 935 - DNA, 14 bp, Artificial sequence
  Synthetic oligonucleotide
caaactaaaaccta

SEQ ID NO: 936 - DNA, 14 bp, Artificial sequence
  Synthetic oligonucleotide
tcaaactaaaacct

SEQ ID NO: 937 - DNA, 14 bp, Artificial sequence
  Synthetic oligonucleotide
atcaaactaaaacc

SEQ ID NO: 938 - DNA, 14 bp, Artificial sequence
  Synthetic oligonucleotide
gatcaaactaaaac

SEQ ID NO: 939 - DNA, 14 bp, Artificial sequence
  Synthetic oligonucleotide
agatcaaactaaaa

SEQ ID NO: 940 - DNA, 14 bp, Artificial sequence
  Synthetic oligonucleotide
aagatcaaactaaa

SEQ ID NO: 941 - DNA, 14 bp, Artificial sequence
  Synthetic oligonucleotide
ccaatttcacccaa

SEQ ID NO: 942 - DNA, 14 bp, Artificial sequence
  Synthetic oligonucleotide
cccaatttcaccca

SEQ ID NO: 943 - DNA, 14 bp, Artificial sequence
  Synthetic oligonucleotide
gcccaatttcaccc

SEQ ID NO: 944 - DNA, 14 bp, Artificial sequence
  Synthetic oligonucleotide
tgcccaatttcacc

SEQ ID NO: 945 - DNA, 14 bp, Artificial sequence
  Synthetic oligonucleotide
ttgcccaatttcac

SEQ ID NO: 946 - DNA, 14 bp, Artificial sequence
  Synthetic oligonucleotide
caactttctatttt

SEQ ID NO: 947 - DNA, 14 bp, Artificial sequence
  Synthetic oligonucleotide
ccaactttctattt

SEQ ID NO: 948 - DNA, 14 bp, Artificial sequence
  Synthetic oligonucleotide
cccaactttctatt

SEQ ID NO: 949 - DNA, 14 bp, Artificial sequence
  Synthetic oligonucleotide
acccaactttctat

SEQ ID NO: 950 - DNA, 14 bp, Artificial sequence
  Synthetic oligonucleotide
aacccaactttcta

SEQ ID NO: 951 - DNA, 14 bp, Artificial sequence
  Synthetic oligonucleotide
aaacccaactttct

SEQ ID NO: 952 - DNA, 14 bp, Artificial sequence
  Synthetic oligonucleotide
aaaacccaactttc

SEQ ID NO: 953 - DNA, 14 bp, Artificial sequence
  Synthetic oligonucleotide
aaaaacccaacttt

SEQ ID NO: 954 - DNA, 14 bp, Artificial sequence
  Synthetic oligonucleotide
caaaaacccaactt

SEQ ID NO: 955 - DNA, 14 bp, Artificial sequence
  Synthetic oligonucleotide
acaaaaacccaact

SEQ ID NO: 956 - DNA, 14 bp, Artificial sequence
  Synthetic oligonucleotide
ctttaaaatttcca

SEQ ID NO: 957 - DNA, 14 bp, Artificial sequence
  Synthetic oligonucleotide
tctttaaaatttcc

SEQ ID NO: 958 - DNA, 14 bp, Artificial sequence
  Synthetic oligonucleotide
ttctttaaaatttc

SEQ ID NO: 959 - DNA, 14 bp, Artificial sequence
  Synthetic oligonucleotide
tttctttaaaattt

SEQ ID NO: 960 - DNA, 14 bp, Artificial sequence
  Synthetic oligonucleotide
atttctttaaaatt

SEQ ID NO: 961 - DNA, 14 bp, Artificial sequence
  Synthetic oligonucleotide
catttctttaaaat

SEQ ID NO: 962 - DNA, 14 bp, Artificial sequence
  Synthetic oligonucleotide
acatttctttaaaa

SEQ ID NO: 963 - DNA, 14 bp, Artificial sequence
  Synthetic oligonucleotide
cacatttctttaaa

SEQ ID NO: 964 - DNA, 14 bp, Artificial sequence
  Synthetic oligonucleotide
ccacatttctttaa

SEQ ID NO: 965 - DNA, 14 bp, Artificial sequence
  Synthetic oligonucleotide
accacatttcttta

SEQ ID NO: 966 - DNA, 14 bp, Artificial sequence
  Synthetic oligonucleotide
aaccacatttcttt

SEQ ID NO: 967 - DNA, 14 bp, Artificial sequence
  Synthetic oligonucleotide
aaaccacatttctt

SEQ ID NO: 968 - DNA, 14 bp, Artificial sequence
  Synthetic oligonucleotide
aaaaccacatttct

SEQ ID NO: 969 - DNA, 14 bp, Artificial sequence
  Synthetic oligonucleotide
caaaaccacatttc

SEQ ID NO: 970 - DNA, 14 bp, Artificial sequence
  Synthetic oligonucleotide
ttcttctcttttca

SEQ ID NO: 971 - DNA, 14 bp, Artificial sequence
  Synthetic oligonucleotide
tttcttctcttttc

SEQ ID NO: 972 - DNA, 14 bp, Artificial sequence
  Synthetic oligonucleotide
ttttcttctctttt

SEQ ID NO: 973 - DNA, 14 bp, Artificial sequence
  Synthetic oligonucleotide
tttttcttctcttt

SEQ ID NO: 974 - DNA, 14 bp, Artificial sequence
  Synthetic oligonucleotide
ttttttcttctctt

SEQ ID NO: 975 - DNA, 14 bp, Artificial sequence
  Synthetic oligonucleotide
attttttcttctct

SEQ ID NO: 976 - DNA, 14 bp, Artificial sequence
  Synthetic oligonucleotide
tattttttcttctc

SEQ ID NO: 977 - DNA, 14 bp, Artificial sequence
  Synthetic oligonucleotide
aacttaatattaaa

SEQ ID NO: 978 - DNA, 14 bp, Artificial sequence
  Synthetic oligonucleotide
caacttaatattaa

SEQ ID NO: 979 - DNA, 14 bp, Artificial sequence
  Synthetic oligonucleotide
tcaacttaatatta

SEQ ID NO: 980 - DNA, 14 bp, Artificial sequence
  Synthetic oligonucleotide
ttcaacttaatatt

SEQ ID NO: 981 - DNA, 14 bp, Artificial sequence
  Synthetic oligonucleotide
attcaacttaatat

SEQ ID NO: 982 - DNA, 14 bp, Artificial sequence
  Synthetic oligonucleotide
tattcaacttaata

SEQ ID NO: 983 - DNA, 14 bp, Artificial sequence
  Synthetic oligonucleotide
ttattcaacttaat

SEQ ID NO: 984 - DNA, 14 bp, Artificial sequence
  Synthetic oligonucleotide
tttattcaacttaa

SEQ ID NO: 985 - DNA, 14 bp, Artificial sequence
  Synthetic oligonucleotide
caaattaaaaaaca

SEQ ID NO: 986 - DNA, 14 bp, Artificial sequence
  Synthetic oligonucleotide
tcaaattaaaaaac

SEQ ID NO: 987 - DNA, 14 bp, Artificial sequence
  Synthetic oligonucleotide
ttcaaattaaaaaa

SEQ ID NO: 988 - DNA, 14 bp, Artificial sequence
  Synthetic oligonucleotide
cttcaaattaaaaa

SEQ ID NO: 989 - DNA, 14 bp, Artificial sequence
  Synthetic oligonucleotide
tcttcaaattaaaa

SEQ ID NO: 990 - DNA, 14 bp, Artificial sequence
  Synthetic oligonucleotide
ttcttcaaattaaa

SEQ ID NO: 991 - DNA, 14 bp, Artificial sequence
  Synthetic oligonucleotide
tttcttcaaattaa

SEQ ID NO: 992 - DNA, 14 bp, Artificial sequence
  Synthetic oligonucleotide
aacacaaattcaaa

SEQ ID NO: 993 - DNA, 14 bp, Artificial sequence
  Synthetic oligonucleotide
aaacacaaattcaa

SEQ ID NO: 994 - DNA, 14 bp, Artificial sequence
  Synthetic oligonucleotide
taaacacaaattca

SEQ ID NO: 995 - DNA, 14 bp, Artificial sequence
  Synthetic oligonucleotide
ataaacacaaattc

SEQ ID NO: 996 - DNA, 14 bp, Artificial sequence
  Synthetic oligonucleotide
aataaacacaaatt

SEQ ID NO: 997 - DNA, 14 bp, Artificial sequence
  Synthetic oligonucleotide
caataaacacaaat

SEQ ID NO: 998 - DNA, 14 bp, Artificial sequence
  Synthetic oligonucleotide
acaataaacacaaa

SEQ ID NO: 999 - DNA, 14 bp, Artificial sequence
  Synthetic oligonucleotide
aacaataaacacaa

SEQ ID NO: 1000 - DNA, 14 bp, Artificial sequence
  Synthetic oligonucleotide
taacaataaacaca

SEQ ID NO: 1001 - DNA, 14 bp, Artificial sequence
  Synthetic oligonucleotide
ttaacaataaacac

SEQ ID NO: 1002 - DNA, 14 bp, Artificial sequence
  Synthetic oligonucleotide
attaacaataaaca

SEQ ID NO: 1003 - DNA, 14 bp, Artificial sequence
  Synthetic oligonucleotide
aattaacaataaac

SEQ ID NO: 1004 - DNA, 14 bp, Artificial sequence
  Synthetic oligonucleotide
gaattaacaataaa

SEQ ID NO: 1005 - DNA, 14 bp, Artificial sequence
  Synthetic oligonucleotide
tgaattaacaataa

SEQ ID NO: 1006 - DNA, 14 bp, Artificial sequence
  Synthetic oligonucleotide
atattcctcaatca

SEQ ID NO: 1007 - DNA, 14 bp, Artificial sequence
  Synthetic oligonucleotide
tatattcctcaatc

SEQ ID NO: 1008 - DNA, 14 bp, Artificial sequence
  Synthetic oligonucleotide
atatattcctcaat

SEQ ID NO: 1009 - DNA, 14 bp, Artificial sequence
  Synthetic oligonucleotide
aatatattcctcaa

SEQ ID NO: 1010 - DNA, 14 bp, Artificial sequence
  Synthetic oligonucleotide
caatatattcctca

SEQ ID NO: 1011 - DNA, 14 bp, Artificial sequence
  Synthetic oligonucleotide
acaatatattcctc

SEQ ID NO: 1012 - DNA, 14 bp, Artificial sequence
  Synthetic oligonucleotide
gacaatatattcct

SEQ ID NO: 1013 - DNA, 14 bp, Artificial sequence
  Synthetic oligonucleotide
caatcctaattaaa

SEQ ID NO: 1014 - DNA, 14 bp, Artificial sequence
  Synthetic oligonucleotide
ccaatcctaattaa

SEQ ID NO: 1015 - DNA, 14 bp, Artificial sequence
  Synthetic oligonucleotide
cccaatcctaatta

SEQ ID NO: 1016 - DNA, 14 bp, Artificial sequence
  Synthetic oligonucleotide
gcccaatcctaatt

SEQ ID NO: 1017 - DNA, 14 bp, Artificial sequence
  Synthetic oligonucleotide
tgcccaatcctaat

SEQ ID NO: 1018 - DNA, 14 bp, Artificial sequence
  Synthetic oligonucleotide
accctacaaatact

SEQ ID NO: 1019 - DNA, 14 bp, Artificial sequence
  Synthetic oligonucleotide
aaccctacaaatac

SEQ ID NO: 1020 - DNA, 14 bp, Artificial sequence
  Synthetic oligonucleotide
aaaccctacaaata

SEQ ID NO: 1021 - DNA, 14 bp, Artificial sequence
  Synthetic oligonucleotide
aaaaccctacaaat

SEQ ID NO: 1022 - DNA, 14 bp, Artificial sequence
  Synthetic oligonucleotide
aaaaaccctacaaa

SEQ ID NO: 1023 - DNA, 14 bp, Artificial sequence
  Synthetic oligonucleotide
aaaaaaccctacaa

SEQ ID NO: 1024 - DNA, 14 bp, Artificial sequence
  Synthetic oligonucleotide
aaaaaaaccctaca

SEQ ID NO: 1025 - DNA, 14 bp, Artificial sequence
  Synthetic oligonucleotide
tatacactattaat

SEQ ID NO: 1026 - DNA, 14 bp, Artificial sequence
  Synthetic oligonucleotide
ttatacactattaa

SEQ ID NO: 1027 - DNA, 14 bp, Artificial sequence
  Synthetic oligonucleotide
attatacactatta

SEQ ID NO: 1028 - DNA, 14 bp, Artificial sequence
  Synthetic oligonucleotide
aattatacactatt

SEQ ID NO: 1029 - DNA, 14 bp, Artificial sequence
  Synthetic oligonucleotide
gaattatacactat

SEQ ID NO: 1030 - DNA, 14 bp, Artificial sequence
  Synthetic oligonucleotide
gtaacaattataca

SEQ ID NO: 1031 - DNA, 14 bp, Artificial sequence
  Synthetic oligonucleotide
tgtaacaattatac

SEQ ID NO: 1032 - DNA, 14 bp, Artificial sequence
  Synthetic oligonucleotide
ctgtaacaattata

SEQ ID NO: 1033 - DNA, 14 bp, Artificial sequence
  Synthetic oligonucleotide
cctgtaacaattat

SEQ ID NO: 1034 - DNA, 14 bp, Artificial sequence
  Synthetic oligonucleotide
tcctgtaacaatta

SEQ ID NO: 1035 - DNA, 14 bp, Artificial sequence
  Synthetic oligonucleotide
ataaaaaccacctt

SEQ ID NO: 1036 - DNA, 14 bp, Artificial sequence
  Synthetic oligonucleotide
aataaaaaccacct

SEQ ID NO: 1037 - DNA, 14 bp, Artificial sequence
  Synthetic oligonucleotide
gaataaaaaccacc

SEQ ID NO: 1038 - DNA, 14 bp, Artificial sequence
  Synthetic oligonucleotide
agaataaaaaccac

SEQ ID NO: 1039 - DNA, 14 bp, Artificial sequence
  Synthetic oligonucleotide
cagaataaaaacca

SEQ ID NO: 1040 - DNA, 14 bp, Artificial sequence
  Synthetic oligonucleotide
ccagaataaaaacc

SEQ ID NO: 1041 - DNA, 14 bp, Artificial sequence
  Synthetic oligonucleotide
cccagaataaaaac

SEQ ID NO: 1042 - DNA, 14 bp, Artificial sequence
  Synthetic oligonucleotide
acccagaataaaaa

SEQ ID NO: 1043 - DNA, 14 bp, Artificial sequence
  Synthetic oligonucleotide
tttcttactcccct

SEQ ID NO: 1044 - DNA, 14 bp, Artificial sequence
  Synthetic oligonucleotide
ctttcttactcccc

SEQ ID NO: 1045 - DNA, 14 bp, Artificial sequence
  Synthetic oligonucleotide
actttcttactccc

SEQ ID NO: 1046 - DNA, 14 bp, Artificial sequence
  Synthetic oligonucleotide
cactttcttactcc

SEQ ID NO: 1047 - DNA, 14 bp, Artificial sequence
  Synthetic oligonucleotide
ccactttcttactc

SEQ ID NO: 1048 - DNA, 14 bp, Artificial sequence
  Synthetic oligonucleotide
cctttaccactttt

SEQ ID NO: 1049 - DNA, 14 bp, Artificial sequence
  Synthetic oligonucleotide
ccctttaccacttt

SEQ ID NO: 1050 - DNA, 14 bp, Artificial sequence
  Synthetic oligonucleotide
tccctttaccactt

SEQ ID NO: 1051 - DNA, 14 bp, Artificial sequence
  Synthetic oligonucleotide
atccctttaccact

SEQ ID NO: 1052 - DNA, 14 bp, Artificial sequence
  Synthetic oligonucleotide
catccctttaccac

SEQ ID NO: 1053 - DNA, 14 bp, Artificial sequence
  Synthetic oligonucleotide
ctacatctaacccc

SEQ ID NO: 1054 - DNA, 14 bp, Artificial sequence
  Synthetic oligonucleotide
tctacatctaaccc

SEQ ID NO: 1055 - DNA, 14 bp, Artificial sequence
  Synthetic oligonucleotide
gtctacatctaacc

SEQ ID NO: 1056 - DNA, 14 bp, Artificial sequence
  Synthetic oligonucleotide
agtctacatctaac

SEQ ID NO: 1057 - DNA, 14 bp, Artificial sequence
  Synthetic oligonucleotide
cagtctacatctaa

SEQ ID NO: 1058 - DNA, 14 bp, Artificial sequence
  Synthetic oligonucleotide
tcagtctacatcta

SEQ ID NO: 1059 - DNA, 14 bp, Artificial sequence
  Synthetic oligonucleotide
ttcagtctacatct

SEQ ID NO: 1060 - DNA, 14 bp, Artificial sequence
  Synthetic oligonucleotide
taaccacacctcct

SEQ ID NO: 1061 - DNA, 14 bp, Artificial sequence
  Synthetic oligonucleotide
ttaaccacacctcc

SEQ ID NO: 1062 - DNA, 14 bp, Artificial sequence
  Synthetic oligonucleotide
tttaaccacacctc

SEQ ID NO: 1063 - DNA, 14 bp, Artificial sequence
  Synthetic oligonucleotide
ttttaaccacacct

SEQ ID NO: 1064 - DNA, 14 bp, Artificial sequence
  Synthetic oligonucleotide
gttttaaccacacc

SEQ ID NO: 1065 - DNA, 14 bp, Artificial sequence
  Synthetic oligonucleotide
agttttaaccacac

SEQ ID NO: 1066 - DNA, 14 bp, Artificial sequence
  Synthetic oligonucleotide
caacaaaacatcaa

SEQ ID NO: 1067 - DNA, 14 bp, Artificial sequence
  Synthetic oligonucleotide
tcaacaaaacatca

SEQ ID NO: 1068 - DNA, 14 bp, Artificial sequence
  Synthetic oligonucleotide
ttcaacaaaacatc

SEQ ID NO: 1069 - DNA, 14 bp, Artificial sequence
  Synthetic oligonucleotide
tttcaacaaaacat

SEQ ID NO: 1070 - DNA, 14 bp, Artificial sequence
  Synthetic oligonucleotide
ttttcaacaaaaca

SEQ ID NO: 1071 - DNA, 14 bp, Artificial sequence
  Synthetic oligonucleotide
gttttcaacaaaac

SEQ ID NO: 1072 - DNA, 14 bp, Artificial sequence
  Synthetic oligonucleotide
tgttttcaacaaaa

SEQ ID NO: 1073 - DNA, 14 bp, Artificial sequence
  Synthetic oligonucleotide
ttctaaaacttacc

SEQ ID NO: 1074 - DNA, 14 bp, Artificial sequence
  Synthetic oligonucleotide
tttctaaaacttac

SEQ ID NO: 1075 - DNA, 14 bp, Artificial sequence
  Synthetic oligonucleotide
ctttctaaaactta

SEQ ID NO: 1076 - DNA, 14 bp, Artificial sequence
  Synthetic oligonucleotide
tctttctaaaactt

SEQ ID NO: 1077 - DNA, 14 bp, Artificial sequence
  Synthetic oligonucleotide
atctttctaaaact

SEQ ID NO: 1078 - DNA, 14 bp, Artificial sequence
  Synthetic oligonucleotide
aatctttctaaaac

SEQ ID NO: 1079 - DNA, 14 bp, Artificial sequence
  Synthetic oligonucleotide
gaatctttctaaaa

SEQ ID NO: 1080 - DNA, 14 bp, Artificial sequence
  Synthetic oligonucleotide
agaatctttctaaa

SEQ ID NO: 1081 - DNA, 14 bp, Artificial sequence
  Synthetic oligonucleotide
cagaatctttctaa

SEQ ID NO: 1082 - DNA, 14 bp, Artificial sequence
  Synthetic oligonucleotide
cctttatttccctt

SEQ ID NO: 1083 - DNA, 14 bp, Artificial sequence
  Synthetic oligonucleotide
ccctttatttccct

SEQ ID NO: 1084 - DNA, 14 bp, Artificial sequence
  Synthetic oligonucleotide
tccctttatttccc

SEQ ID NO: 1085 - DNA, 14 bp, Artificial sequence
  Synthetic oligonucleotide
ttccctttatttcc

SEQ ID NO: 1086 - DNA, 14 bp, Artificial sequence
  Synthetic oligonucleotide
tttccctttatttc

SEQ ID NO: 1087 - DNA, 14 bp, Artificial sequence
  Synthetic oligonucleotide
atttccctttattt

SEQ ID NO: 1088 - DNA, 14 bp, Artificial sequence
  Synthetic oligonucleotide
tatttccctttatt

SEQ ID NO: 1089 - DNA, 14 bp, Artificial sequence
  Synthetic oligonucleotide
gtatttccctttat

SEQ ID NO: 1090 - DNA, 27 bp, Artificial
  Probe
ctgaacagcctccttggtcttcttgta

SEQ ID NO: 1091 - DNA, 21 bp, artificial
  Primer
cttgccagctctcattctctg

SEQ ID NO: 1092 - DNA, 21 bp, Artificial
  Primer
tggtggttgaagataaggttg

SEQ ID NO: 1093 - DNA, 17 bp, Homo sapiens
aagagtaaaatatgggt

SEQ ID NO: 1094 - DNA, 18 bp, Homo sapiens
gaatgtaaaagtgtacag

SEQ ID NO: 1095 - DNA, 18 bp, Homo sapiens
ggaatgtaaaagtgtaca

SEQ ID NO: 1096 - DNA, 18 bp, Homo sapiens
gggaatgtaaaagtgtac

SEQ ID NO: 1097 - DNA, 19 bp, Homo sapiens
ttgatggtataatgaagaa

SEQ ID NO: 1098 - DNA, 19 bp, Homo sapiens
ggaagatgtaaataagatt

SEQ ID NO: 1099 - DNA, 18 bp, Artificial sequence
  Synthetic oligonucleotide
ccaaaagaaaccaaaccc

SEQ ID NO: 1100 - DNA, 19 bp, Artificial sequence
  Synthetic oligonucleotide
ccccattcaaatatttatt

SEQ ID NO: 1101 - DNA, 17 bp, Artificial sequence
  Synthetic oligonucleotide
aatcatttacccccaac

SEQ ID NO: 1102 - DNA, 18 bp, Artificial sequence
  Synthetic oligonucleotide
tatctcaaactatcccca

SEQ ID NO: 1103 - DNA, 18 bp, Artificial sequence
  Synthetic oligonucleotide
tctattccttaacccaac

SEQ ID NO: 1104 - DNA, 20 bp, Artificial sequence
  Synthetic oligonucleotide
tcccctaaataatttaatca

SEQ ID NO: 1105 - DNA, 17 bp, Artificial sequence
  Synthetic oligonucleotide
aaaccactccattccaa

SEQ ID NO: 1106 - DNA, 19 bp, Artificial sequence
  Synthetic oligonucleotide
tctaaaccccaaactttca

SEQ ID NO: 1107 - DNA, 19 bp, Artificial sequence
  Synthetic oligonucleotide
ttctaaaccccaaactttc

SEQ ID NO: 1108 - DNA, 18 bp, Artificial sequence
  Synthetic oligonucleotide
agttctaaaccccaaact

SEQ ID NO: 1109 - DNA, 19 bp, Artificial sequence
  Synthetic oligonucleotide
tgaaaccattactacaacc

SEQ ID NO: 1110 - DNA, 20 bp, Artificial sequence
  Synthetic oligonucleotide
acatcatttatcactaccac

SEQ ID NO: 1111 - DNA, 17 bp, Artificial sequence
  Synthetic oligonucleotide
aacattaaaccctccca

SEQ ID NO: 1112 - DNA, 18 bp, Artificial sequence
  Synthetic oligonucleotide
tcagatcctaaaatcact

SEQ ID NO: 1113 - DNA, 19 bp, Artificial sequence
  Synthetic oligonucleotide
ctatacctaaaacaatcta

SEQ ID NO: 1114 - DNA, 18 bp, Artificial sequence
  Synthetic oligonucleotide
tgattcttatacttacta

SEQ ID NO: 1115 - DNA, 20 bp, Artificial sequence
  Synthetic oligonucleotide
taaaaatataactactccta

SEQ ID NO: 1116 - DNA, 20 bp, Artificial sequence
  Synthetic oligonucleotide
tcttcattataccatcaaat

SEQ ID NO: 1117 - DNA, 18 bp, Artificial sequence
  Synthetic oligonucleotide
gtttcatatttttaatcc

SEQ ID NO: 1118 - DNA, 20 bp, Artificial sequence
  Synthetic oligonucleotide
taatatcctcattacccatt

SEQ ID NO: 1119 - DNA, 19 bp, Artificial sequence
  Synthetic oligonucleotide
caaatattcacaaatccta

SEQ ID NO: 1120 - DNA, 20 bp, Artificial sequence
  Synthetic oligonucleotide
catcacaaaataacctatca

SEQ ID NO: 1121 - DNA, 20 bp, Artificial sequence
  Synthetic oligonucleotide
ctctcaacttctactactaa

SEQ ID NO: 1122 - DNA, 19 bp, Artificial sequence
  Synthetic oligonucleotide
aatcttatttacatcttcc

SEQ ID NO: 1123 - DNA, 20 bp, Artificial sequence
  Synthetic oligonucleotide
ccaaaattacttcttttatc

SEQ ID NO: 1124 - DNA, 18 bp, Artificial sequence
  Synthetic oligonucleotide
aacccaactttctatttt

SEQ ID NO: 1125 - DNA, 19 bp, Artificial sequence
  Synthetic oligonucleotide
acaatatattcctcaatca

SEQ ID NO: 1126 - DNA, 17 bp, Artificial sequence
  Synthetic oligonucleotide
cctgtaacaattataca

SEQ ID NO: 1127 - DNA, 17 bp, Artificial sequence
  Synthetic oligonucleotide
catccctttaccacttt

SEQ ID NO: 1128 - DNA, 23 bp, artificial
  Primer
gtttctaaagacatggtcacagc

SEQ ID NO: 1129 - DNA, 23 bp, artificial
  Primer
ctatcaggacagagttcacatcc

SEQ ID NO: 1130 - DNA, 22 bp, artificial
  FAM labelled probe
aaaggccagccaccagttcagg

SEQ ID NO: 1131 - DNA, 25 bp, artificial
  FAM labelled probe
tgatctttgcagtgacccagcatca

SEQ ID NO: 1132 - DNA, 20 bp, artificial
  Primer
gctgtttaacttcgcttccg

SEQ ID NO: 1133 - DNA, 21 bp, artificial
  Primer
cagcaacttcctcaattcctt

SEQ ID NO: 1134 - DNA, 24 bp, artificial
  FAM lebelled probe
ctccgcagggctattcagctaagt

SEQ ID NO: 1135 - DNA, 25 bp, artificial
  Primer
agtaagatttgtacctgatgtctgt

SEQ ID NO: 1136 - DNA, 22 bp, artificial
  Primer
catggaagatgaggaagcagat

SEQ ID NO: 1137 - DNA, 17 bp, Artificial sequence
  Synthetic oligonucleotide
cctacttcacttcctaa

SEQ ID NO: 1138 - DNA, 19 bp, Artificial sequence
  Synthetic oligonucleotide
tttcctacttcacttccta

SEQ ID NO: 1139 - DNA, 18 bp, Artificial sequence
  Synthetic oligonucleotide
ttcctacttcacttccta

SEQ ID NO: 1140 - DNA, 18 bp, Artificial sequence
  Synthetic oligonucleotide
tttcctacttcacttcct

SEQ ID NO: 1141 - DNA, 17 bp, Artificial sequence
  Synthetic oligonucleotide
tttcctacttcacttcc

SEQ ID NO: 1142 - DNA, 17 bp, Artificial sequence
  Synthetic oligonucleotide
gtttcctacttcacttc

SEQ ID NO: 1143 - DNA, 18 bp, Artificial sequence
  Synthetic oligonucleotide
accaaacccaaacatccc

SEQ ID NO: 1144 - DNA, 20 bp, Artificial sequence
  Synthetic oligonucleotide
agaaaccaaacccaaacatc

SEQ ID NO: 1145 - DNA, 19 bp, Artificial sequence
  Synthetic oligonucleotide
agaaaccaaacccaaacat

SEQ ID NO: 1146 - DNA, 21 bp, Artificial sequence
  Synthetic oligonucleotide
ctcctaatacctaaaaacaaa

SEQ ID NO: 1147 - DNA, 19 bp, Artificial sequence
  Synthetic oligonucleotide
ctcctaatacctaaaaaca

SEQ ID NO: 1148 - DNA, 20 bp, Artificial sequence
  Synthetic oligonucleotide
actcctaatacctaaaaaca

SEQ ID NO: 1149 - DNA, 21 bp, Artificial sequence
  Synthetic oligonucleotide
cactcctaatacctaaaaaca

SEQ ID NO: 1150 - DNA, 20 bp, Artificial sequence
  Synthetic oligonucleotide
ccactcctaatacctaaaaa

SEQ ID NO: 1151 - DNA, 21 bp, Artificial sequence
  Synthetic oligonucleotide
tccactcctaatacctaaaaa

SEQ ID NO: 1152 - DNA, 19 bp, Artificial sequence
  Synthetic oligonucleotide
ccactcctaatacctaaaa

SEQ ID NO: 1153 - DNA, 20 bp, Artificial sequence
  Synthetic oligonucleotide
tccactcctaatacctaaaa

SEQ ID NO: 1154 - DNA, 18 bp, Artificial sequence
  Synthetic oligonucleotide
ccactcctaatacctaaa

SEQ ID NO: 1155 - DNA, 20 bp, Artificial sequence
  Synthetic oligonucleotide
gtccactcctaatacctaaa

SEQ ID NO: 1156 - DNA, 17 bp, Artificial sequence
  Synthetic oligonucleotide
ccactcctaatacctaa

SEQ ID NO: 1157 - DNA, 18 bp, Artificial sequence
  Synthetic oligonucleotide
tccactcctaatacctaa

SEQ ID NO: 1158 - DNA, 19 bp, Artificial sequence
  Synthetic oligonucleotide
gtccactcctaatacctaa

SEQ ID NO: 1159 - DNA, 19 bp, Artificial sequence
  Synthetic oligonucleotide
agtccactcctaataccta

SEQ ID NO: 1160 - DNA, 17 bp, Artificial sequence
  Synthetic oligonucleotide
tccactcctaataccta

SEQ ID NO: 1161 - DNA, 18 bp, Artificial sequence
  Synthetic oligonucleotide
agtccactcctaatacct

SEQ ID NO: 1162 - DNA, 16 bp, Artificial sequence
  Synthetic oligonucleotide
gtccactcctaatacc

SEQ ID NO: 1163 - DNA, 17 bp, Artificial sequence
  Synthetic oligonucleotide
agtccactcctaatacc

SEQ ID NO: 1164 - DNA, 18 bp, Artificial sequence
  Synthetic oligonucleotide
cagtccactcctaatacc

SEQ ID NO: 1165 - DNA, 18 bp, Artificial sequence
  Synthetic oligonucleotide
ccagtccactcctaatac

SEQ ID NO: 1166 - DNA, 17 bp, Artificial sequence
  Synthetic oligonucleotide
cagtccactcctaatac

SEQ ID NO: 1167 - DNA, 16 bp, Artificial sequence
  Synthetic oligonucleotide
agtccactcctaatac

SEQ ID NO: 1168 - DNA, 16 bp, Artificial sequence
  Synthetic oligonucleotide
cagtccactcctaata

SEQ ID NO: 1169 - DNA, 17 bp, Artificial sequence
  Synthetic oligonucleotide
ccagtccactcctaata

SEQ ID NO: 1170 - DNA, 17 bp, Artificial sequence
  Synthetic oligonucleotide
gcaactctttccaaaca

SEQ ID NO: 1171 - DNA, 18 bp, Artificial sequence
  Synthetic oligonucleotide
agcaactctttccaaaca

SEQ ID NO: 1172 - DNA, 19 bp, Artificial sequence
  Synthetic oligonucleotide
cagcaactctttccaaaca

SEQ ID NO: 1173 - DNA, 18 bp, Artificial sequence
  Synthetic oligonucleotide
ccagcaactctttccaaa

SEQ ID NO: 1174 - DNA, 17 bp, Artificial sequence
  Synthetic oligonucleotide
ccagcaactctttccaa

SEQ ID NO: 1175 - DNA, 18 bp, Artificial sequence
  Synthetic oligonucleotide
accagcaactctttccaa

SEQ ID NO: 1176 - DNA, 17 bp, Artificial sequence
  Synthetic oligonucleotide
ttaccagcaactctttc

SEQ ID NO: 1177 - DNA, 19 bp, Artificial sequence
  Synthetic oligonucleotide
tgctcctcctattaaataa

SEQ ID NO: 1178 - DNA, 18 bp, Artificial sequence
  Synthetic oligonucleotide
gctcctcctattaaataa

SEQ ID NO: 1179 - DNA, 17 bp, Artificial sequence
  Synthetic oligonucleotide
gctcctcctattaaata

SEQ ID NO: 1180 - DNA, 18 bp, Artificial sequence
  Synthetic oligonucleotide
tgctcctcctattaaata

SEQ ID NO: 1181 - DNA, 17 bp, Artificial sequence
  Synthetic oligonucleotide
tgctcctcctattaaat

SEQ ID NO: 1182 - DNA, 18 bp, Artificial sequence
  Synthetic oligonucleotide
ttgctcctcctattaaat

SEQ ID NO: 1183 - DNA, 21 bp, Artificial sequence
  Synthetic oligonucleotide
atttaataaaacaaaaaccct

SEQ ID NO: 1184 - DNA, 17 bp, Artificial sequence
  Synthetic oligonucleotide
gcccaaaaaactaaatt

SEQ ID NO: 1185 - DNA, 18 bp, Artificial sequence
  Synthetic oligonucleotide
gtttttacattctaactt

SEQ ID NO: 1186 - DNA, 18 bp, Artificial sequence
  Synthetic oligonucleotide
tgtttttacattctaact

SEQ ID NO: 1187 - DNA, 18 bp, Artificial sequence
  Synthetic oligonucleotide
ctgtttttacattctaac

SEQ ID NO: 1188 - DNA, 18 bp, Artificial sequence
  Synthetic oligonucleotide
ccccattcaaatatttat

SEQ ID NO: 1189 - DNA, 19 bp, Artificial sequence
  Synthetic oligonucleotide
gccccattcaaatatttat

SEQ ID NO: 1190 - DNA, 18 bp, Artificial sequence
  Synthetic oligonucleotide
gccccattcaaatattta

SEQ ID NO: 1191 - DNA, 21 bp, Artificial sequence
  Synthetic oligonucleotide
ccattcaaatatatacatttt

SEQ ID NO: 1192 - DNA, 21 bp, Artificial sequence
  Synthetic oligonucleotide
tccattcaaatatatacattt

SEQ ID NO: 1193 - DNA, 21 bp, Artificial sequence
  Synthetic oligonucleotide
atccattcaaatatatacatt

SEQ ID NO: 1194 - DNA, 20 bp, Artificial sequence
  Synthetic oligonucleotide
tccattcaaatatatacatt

SEQ ID NO: 1195 - DNA, 21 bp, Artificial sequence
  Synthetic oligonucleotide
tatccattcaaatatatacat

SEQ ID NO: 1196 - DNA, 19 bp, Artificial sequence
  Synthetic oligonucleotide
tccattcaaatatatacat

SEQ ID NO: 1197 - DNA, 19 bp, Artificial sequence
  Synthetic oligonucleotide
atccattcaaatatataca

SEQ ID NO: 1198 - DNA, 21 bp, Artificial sequence
  Synthetic oligonucleotide
ttatccattcaaatatataca

SEQ ID NO: 1199 - DNA, 18 bp, Artificial sequence
  Synthetic oligonucleotide
tccattcaaatatataca

SEQ ID NO: 1200 - DNA, 20 bp, Artificial sequence
  Synthetic oligonucleotide
tatccattcaaatatataca

SEQ ID NO: 1201 - DNA, 21 bp, Artificial sequence
  Synthetic oligonucleotide
ctttatccattcaaatatata

SEQ ID NO: 1202 - DNA, 21 bp, Artificial sequence
  Synthetic oligonucleotide
tctttatccattcaaatatat

SEQ ID NO: 1203 - DNA, 21 bp, Artificial sequence
  Synthetic oligonucleotide
ctctttatccattcaaatata

SEQ ID NO: 1204 - DNA, 20 bp, Artificial sequence
  Synthetic oligonucleotide
tctttatccattcaaatata

SEQ ID NO: 1205 - DNA, 19 bp, Artificial sequence
  Synthetic oligonucleotide
ctttatccattcaaatata

SEQ ID NO: 1206 - DNA, 21 bp, Artificial sequence
  Synthetic oligonucleotide
tctctttatccattcaaatat

SEQ ID NO: 1207 - DNA, 20 bp, Artificial sequence
  Synthetic oligonucleotide
ctctttatccattcaaatat

SEQ ID NO: 1208 - DNA, 19 bp, Artificial sequence
  Synthetic oligonucleotide
tctttatccattcaaatat

SEQ ID NO: 1209 - DNA, 20 bp, Artificial sequence
  Synthetic oligonucleotide
tctctttatccattcaaata

SEQ ID NO: 1210 - DNA, 19 bp, Artificial sequence
  Synthetic oligonucleotide
ctctttatccattcaaata

SEQ ID NO: 1211 - DNA, 19 bp, Artificial sequence
  Synthetic oligonucleotide
tctctttatccattcaaat

SEQ ID NO: 1212 - DNA, 18 bp, Artificial sequence
  Synthetic oligonucleotide
tctctttatccattcaaa

SEQ ID NO: 1213 - DNA, 18 bp, Artificial sequence
  Synthetic oligonucleotide
agcaccatatatatctca

SEQ ID NO: 1214 - DNA, 17 bp, Artificial sequence
  Synthetic oligonucleotide
gcaccatatatatctca

SEQ ID NO: 1215 - DNA, 19 bp, Artificial sequence
  Synthetic oligonucleotide
cagcaccatatatatctca

SEQ ID NO: 1216 - DNA, 17 bp, Artificial sequence
  Synthetic oligonucleotide
agcaccatatatatctc

SEQ ID NO: 1217 - DNA, 16 bp, Artificial sequence
  Synthetic oligonucleotide
gcaccatatatatctc

SEQ ID NO: 1218 - DNA, 18 bp, Artificial sequence
  Synthetic oligonucleotide
cagcaccatatatatctc

SEQ ID NO: 1219 - DNA, 17 bp, Artificial sequence
  Synthetic oligonucleotide
cagcaccatatatatct

SEQ ID NO: 1220 - DNA, 18 bp, Artificial sequence
  Synthetic oligonucleotide
acagcaccatatatatct

SEQ ID NO: 1221 - DNA, 17 bp, Artificial sequence
  Synthetic oligonucleotide
acagcaccatatatatc

SEQ ID NO: 1222 - DNA, 17 bp, Artificial sequence
  Synthetic oligonucleotide
ctatgttattatcccca

SEQ ID NO: 1223 - DNA, 17 bp, Artificial sequence
  Synthetic oligonucleotide
tctatgttattatcccc

SEQ ID NO: 1224 - DNA, 17 bp, Artificial sequence
  Synthetic oligonucleotide
ctctacactctaactct

SEQ ID NO: 1225 - DNA, 18 bp, Artificial sequence
  Synthetic oligonucleotide
tctctacactctaactct

SEQ ID NO: 1226 - DNA, 19 bp, Artificial sequence
  Synthetic oligonucleotide
ttctctacactctaactct

SEQ ID NO: 1227 - DNA, 20 bp, Artificial sequence
  Synthetic oligonucleotide
cttctctacactctaactct

SEQ ID NO: 1228 - DNA, 18 bp, Artificial sequence
  Synthetic oligonucleotide
ttctctacactctaactc

SEQ ID NO: 1229 - DNA, 19 bp, Artificial sequence
  Synthetic oligonucleotide
cttctctacactctaactc

SEQ ID NO: 1230 - DNA, 17 bp, Artificial sequence
  Synthetic oligonucleotide
tctctacactctaactc

SEQ ID NO: 1231 - DNA, 20 bp, Artificial sequence
  Synthetic oligonucleotide
ccttctctacactctaactc

SEQ ID NO: 1232 - DNA, 17 bp, Artificial sequence
  Synthetic oligonucleotide
ttctctacactctaact

SEQ ID NO: 1233 - DNA, 18 bp, Artificial sequence
  Synthetic oligonucleotide
cttctctacactctaact

SEQ ID NO: 1234 - DNA, 19 bp, Artificial sequence
  Synthetic oligonucleotide
ccttctctacactctaact

SEQ ID NO: 1235 - DNA, 18 bp, Artificial sequence
  Synthetic oligonucleotide
ccttctctacactctaac

SEQ ID NO: 1236 - DNA, 17 bp, Artificial sequence
  Synthetic oligonucleotide
cttctctacactctaac

SEQ ID NO: 1237 - DNA, 19 bp, Artificial sequence
  Synthetic oligonucleotide
agccttctctacactctaa

SEQ ID NO: 1238 - DNA, 17 bp, Artificial sequence
  Synthetic oligonucleotide
ccttctctacactctaa

SEQ ID NO: 1239 - DNA, 18 bp, Artificial sequence
  Synthetic oligonucleotide
gccttctctacactctaa

SEQ ID NO: 1240 - DNA, 18 bp, Artificial sequence
  Synthetic oligonucleotide
agccttctctacactcta

SEQ ID NO: 1241 - DNA, 21 bp, Artificial sequence
  Synthetic oligonucleotide
tactaactacaacacaaatca

SEQ ID NO: 1242 - DNA, 21 bp, Artificial sequence
  Synthetic oligonucleotide
ctactaactacaacacaaatc

SEQ ID NO: 1243 - DNA, 21 bp, Artificial sequence
  Synthetic oligonucleotide
cactactaactacaacacaaa

SEQ ID NO: 1244 - DNA, 20 bp, Artificial sequence
  Synthetic oligonucleotide
cactactaactacaacacaa

SEQ ID NO: 1245 - DNA, 21 bp, Artificial sequence
  Synthetic oligonucleotide
acactactaactacaacacaa

SEQ ID NO: 1246 - DNA, 19 bp, Artificial sequence
  Synthetic oligonucleotide
cactactaactacaacaca

SEQ ID NO: 1247 - DNA, 20 bp, Artificial sequence
  Synthetic oligonucleotide
acactactaactacaacaca

SEQ ID NO: 1248 - DNA, 20 bp, Artificial sequence
  Synthetic oligonucleotide
gacactactaactacaacac

SEQ ID NO: 1249 - DNA, 19 bp, Artificial sequence
  Synthetic oligonucleotide
gacactactaactacaaca

SEQ ID NO: 1250 - DNA, 18 bp, Artificial sequence
  Synthetic oligonucleotide
agacactactaactacaa

SEQ ID NO: 1251 - DNA, 17 bp, Artificial sequence
  Synthetic oligonucleotide
agacactactaactaca

SEQ ID NO: 1252 - DNA, 18 bp, Artificial sequence
  Synthetic oligonucleotide
atcatttacccccaacct

SEQ ID NO: 1253 - DNA, 17 bp, Artificial sequence
  Synthetic oligonucleotide
atcatttacccccaacc

SEQ ID NO: 1254 - DNA, 18 bp, Artificial sequence
  Synthetic oligonucleotide
caaatcatttacccccaa

SEQ ID NO: 1255 - DNA, 19 bp, Artificial sequence
  Synthetic oligonucleotide
ccaaatcatttacccccaa

SEQ ID NO: 1256 - DNA, 19 bp, Artificial sequence
  Synthetic oligonucleotide
accaaatcatttaccccca

SEQ ID NO: 1257 - DNA, 19 bp, Artificial sequence
  Synthetic oligonucleotide
taccaaatcatttaccccc

SEQ ID NO: 1258 - DNA, 17 bp, Artificial sequence
  Synthetic oligonucleotide
accaaatcatttacccc

SEQ ID NO: 1259 - DNA, 18 bp, Artificial sequence
  Synthetic oligonucleotide
taccaaatcatttacccc

SEQ ID NO: 1260 - DNA, 19 bp, Artificial sequence
  Synthetic oligonucleotide
ctaccaaatcatttacccc

SEQ ID NO: 1261 - DNA, 17 bp, Artificial sequence
  Synthetic oligonucleotide
taccaaatcatttaccc

SEQ ID NO: 1262 - DNA, 17 bp, Artificial sequence
  Synthetic oligonucleotide
ctaccaaatcatttacc

SEQ ID NO: 1263 - DNA, 19 bp, Artificial sequence
  Synthetic oligonucleotide
tgctaccaaatcatttacc

SEQ ID NO: 1264 - DNA, 18 bp, Artificial sequence
  Synthetic oligonucleotide
gctaccaaatcatttacc

SEQ ID NO: 1265 - DNA, 18 bp, Artificial sequence
  Synthetic oligonucleotide
tgctaccaaatcatttac

SEQ ID NO: 1266 - DNA, 17 bp, Artificial sequence
  Synthetic oligonucleotide
gctaccaaatcatttac

SEQ ID NO: 1267 - DNA, 17 bp, Artificial sequence
  Synthetic oligonucleotide
tgctaccaaatcattta

SEQ ID NO: 1268 - DNA, 18 bp, Artificial sequence
  Synthetic oligonucleotide
ctgctaccaaatcattta

SEQ ID NO: 1269 - DNA, 18 bp, Artificial sequence
  Synthetic oligonucleotide
actgctaccaaatcattt

SEQ ID NO: 1270 - DNA, 17 bp, Artificial sequence
  Synthetic oligonucleotide
ctgctaccaaatcattt

SEQ ID NO: 1271 - DNA, 17 bp, Artificial sequence
  Synthetic oligonucleotide
actgctaccaaatcatt

SEQ ID NO: 1272 - DNA, 17 bp, Artificial sequence
  Synthetic oligonucleotide
cactttgccataatcaa

SEQ ID NO: 1273 - DNA, 19 bp, Artificial sequence
  Synthetic oligonucleotide
ttatctcaaactatcccca

SEQ ID NO: 1274 - DNA, 17 bp, Artificial sequence
  Synthetic oligonucleotide
atctcaaactatcccca

SEQ ID NO: 1275 - DNA, 20 bp, Artificial sequence
  Synthetic oligonucleotide
cttatctcaaactatcccca

SEQ ID NO: 1276 - DNA, 17 bp, Artificial sequence
  Synthetic oligonucleotide
tatctcaaactatcccc

SEQ ID NO: 1277 - DNA, 19 bp, Artificial sequence
  Synthetic oligonucleotide
cttatctcaaactatcccc

SEQ ID NO: 1278 - DNA, 18 bp, Artificial sequence
  Synthetic oligonucleotide
ttatctcaaactatcccc

SEQ ID NO: 1279 - DNA, 18 bp, Artificial sequence
  Synthetic oligonucleotide
cttatctcaaactatccc

SEQ ID NO: 1280 - DNA, 19 bp, Artificial sequence
  Synthetic oligonucleotide
ccttatctcaaactatccc

SEQ ID NO: 1281 - DNA, 17 bp, Artificial sequence
  Synthetic oligonucleotide
ttatctcaaactatccc

SEQ ID NO: 1282 - DNA, 17 bp, Artificial sequence
  Synthetic oligonucleotide
cttatctcaaactatcc

SEQ ID NO: 1283 - DNA, 19 bp, Artificial sequence
  Synthetic oligonucleotide
cccttatctcaaactatcc

SEQ ID NO: 1284 - DNA, 18 bp, Artificial sequence
  Synthetic oligonucleotide
ccttatctcaaactatcc

SEQ ID NO: 1285 - DNA, 17 bp, Artificial sequence
  Synthetic oligonucleotide
ccttatctcaaactatc

SEQ ID NO: 1286 - DNA, 19 bp, Artificial sequence
  Synthetic oligonucleotide
gcccttatctcaaactatc

SEQ ID NO: 1287 - DNA, 18 bp, Artificial sequence
  Synthetic oligonucleotide
cccttatctcaaactatc

SEQ ID NO: 1288 - DNA, 19 bp, Artificial sequence
  Synthetic oligonucleotide
tgcccttatctcaaactat

SEQ ID NO: 1289 - DNA, 18 bp, Artificial sequence
  Synthetic oligonucleotide
gcccttatctcaaactat

SEQ ID NO: 1290 - DNA, 17 bp, Artificial sequence
  Synthetic oligonucleotide
cccttatctcaaactat

SEQ ID NO: 1291 - DNA, 17 bp, Artificial sequence
  Synthetic oligonucleotide
gcccttatctcaaacta

SEQ ID NO: 1292 - DNA, 18 bp, Artificial sequence
  Synthetic oligonucleotide
tgcccttatctcaaacta

SEQ ID NO: 1293 - DNA, 17 bp, Artificial sequence
  Synthetic oligonucleotide
tgcccttatctcaaact

SEQ ID NO: 1294 - DNA, 17 bp, Artificial sequence
  Synthetic oligonucleotide
ttgcccttatctcaaac

SEQ ID NO: 1295 - DNA, 16 bp, Artificial sequence
  Synthetic oligonucleotide
cttgcccttatctcaa

SEQ ID NO: 1296 - DNA, 18 bp, Artificial sequence
  Synthetic oligonucleotide
tgaaatcaaacttcatca

SEQ ID NO: 1297 - DNA, 16 bp, Artificial sequence
  Synthetic oligonucleotide
ggtcaccatacttaat

SEQ ID NO: 1298 - DNA, 18 bp, Artificial sequence
  Synthetic oligonucleotide
tgctaacacaaatttcct

SEQ ID NO: 1299 - DNA, 17 bp, Artificial sequence
  Synthetic oligonucleotide
gctaacacaaatttcct

SEQ ID NO: 1300 - DNA, 18 bp, Artificial sequence
  Synthetic oligonucleotide
ttgctaacacaaatttcc

SEQ ID NO: 1301 - DNA, 17 bp, Artificial sequence
  Synthetic oligonucleotide
tgctaacacaaatttcc

SEQ ID NO: 1302 - DNA, 17 bp, Artificial sequence
  Synthetic oligonucleotide
ttgctaacacaaatttc

SEQ ID NO: 1303 - DNA, 17 bp, Artificial sequence
  Synthetic oligonucleotide
cctttgctaacacaaat

SEQ ID NO: 1304 - DNA, 19 bp, Artificial sequence
  Synthetic oligonucleotide
gtataaccaataataacta

SEQ ID NO: 1305 - DNA, 18 bp, Artificial sequence
  Synthetic oligonucleotide
tctgacatcacacaattt

SEQ ID NO: 1306 - DNA, 17 bp, Artificial sequence
  Synthetic oligonucleotide
tctgacatcacacaatt

SEQ ID NO: 1307 - DNA, 17 bp, Artificial sequence
  Synthetic oligonucleotide
tatctgacatcacacaa

SEQ ID NO: 1308 - DNA, 17 bp, Artificial sequence
  Synthetic oligonucleotide
ctattccttaacccaac

SEQ ID NO: 1309 - DNA, 19 bp, Artificial sequence
  Synthetic oligonucleotide
gtctattccttaacccaac

SEQ ID NO: 1310 - DNA, 18 bp, Artificial sequence
  Synthetic oligonucleotide
gtctattccttaacccaa

SEQ ID NO: 1311 - DNA, 17 bp, Artificial sequence
  Synthetic oligonucleotide
tctattccttaacccaa

SEQ ID NO: 1312 - DNA, 17 bp, Artificial sequence
  Synthetic oligonucleotide
gtctattccttaaccca

SEQ ID NO: 1313 - DNA, 16 bp, Artificial sequence
  Synthetic oligonucleotide
gtctattccttaaccc

SEQ ID NO: 1314 - DNA, 16 bp, Artificial sequence
  Synthetic oligonucleotide
ggtctattccttaacc

SEQ ID NO: 1315 - DNA, 18 bp, Artificial sequence
  Synthetic oligonucleotide
agaacatttccttctcct

SEQ ID NO: 1316 - DNA, 17 bp, Artificial sequence
  Synthetic oligonucleotide
aactgtcccaaacaacc

SEQ ID NO: 1317 - DNA, 18 bp, Artificial sequence
  Synthetic oligonucleotide
ttagtctccctcattttc

SEQ ID NO: 1318 - DNA, 17 bp, Artificial sequence
  Synthetic oligonucleotide
atttagtctccctcatt

SEQ ID NO: 1319 - DNA, 17 bp, Artificial sequence
  Synthetic oligonucleotide
atgcatcaaatctcata

SEQ ID NO: 1320 - DNA, 21 bp, Artificial sequence
  Synthetic oligonucleotide
cctaaataatttaatcattaa

SEQ ID NO: 1321 - DNA, 21 bp, Artificial sequence
  Synthetic oligonucleotide
ccctaaataatttaatcatta

SEQ ID NO: 1322 - DNA, 21 bp, Artificial sequence
  Synthetic oligonucleotide
cccctaaataatttaatcatt

SEQ ID NO: 1323 - DNA, 20 bp, Artificial sequence
  Synthetic oligonucleotide
ccctaaataatttaatcatt

SEQ ID NO: 1324 - DNA, 19 bp, Artificial sequence
  Synthetic oligonucleotide
ccctaaataatttaatcat

SEQ ID NO: 1325 - DNA, 19 bp, Artificial sequence
  Synthetic oligonucleotide
cccctaaataatttaatca

SEQ ID NO: 1326 - DNA, 18 bp, Artificial sequence
  Synthetic oligonucleotide
ccctaaataatttaatca

SEQ ID NO: 1327 - DNA, 18 bp, Artificial sequence
  Synthetic oligonucleotide
cccctaaataatttaatc

SEQ ID NO: 1328 - DNA, 19 bp, Artificial sequence
  Synthetic oligonucleotide
tcccctaaataatttaatc

SEQ ID NO: 1329 - DNA, 18 bp, Artificial sequence
  Synthetic oligonucleotide
ttgctaatatttccaaaa

SEQ ID NO: 1330 - DNA, 17 bp, Artificial sequence
  Synthetic oligonucleotide
cttgctaatatttccaa

SEQ ID NO: 1331 - DNA, 18 bp, Artificial sequence
  Synthetic oligonucleotide
actgtcatccatatttcc

SEQ ID NO: 1332 - DNA, 17 bp, Artificial sequence
  Synthetic oligonucleotide
actgtcatccatatttc

SEQ ID NO: 1333 - DNA, 18 bp, Artificial sequence
  Synthetic oligonucleotide
aatgccccactctaatat

SEQ ID NO: 1334 - DNA, 16 bp, Artificial sequence
  Synthetic oligonucleotide
tgccccactctaatat

SEQ ID NO: 1335 - DNA, 17 bp, Artificial sequence
  Synthetic oligonucleotide
atgccccactctaatat

SEQ ID NO: 1336 - DNA, 18 bp, Artificial sequence
  Synthetic oligonucleotide
aaatgccccactctaata

SEQ ID NO: 1337 - DNA, 16 bp, Artificial sequence
  Synthetic oligonucleotide
atgccccactctaata

SEQ ID NO: 1338 - DNA, 17 bp, Artificial sequence
  Synthetic oligonucleotide
aatgccccactctaata

SEQ ID NO: 1339 - DNA, 17 bp, Artificial sequence
  Synthetic oligonucleotide
ttaaatgccccactcta

SEQ ID NO: 1340 - DNA, 18 bp, Artificial sequence
  Synthetic oligonucleotide
tctgaaaattcactatct

SEQ ID NO: 1341 - DNA, 17 bp, Artificial sequence
  Synthetic oligonucleotide
gtctactatatacatct

SEQ ID NO: 1342 - DNA, 18 bp, Artificial sequence
  Synthetic oligonucleotide
agtctactatatacatct

SEQ ID NO: 1343 - DNA, 17 bp, Artificial sequence
  Synthetic oligonucleotide
agtctactatatacatc

SEQ ID NO: 1344 - DNA, 16 bp, Artificial sequence
  Synthetic oligonucleotide
gtctactatatacatc

SEQ ID NO: 1345 - DNA, 18 bp, Artificial sequence
  Synthetic oligonucleotide
tagtctactatatacatc

SEQ ID NO: 1346 - DNA, 17 bp, Artificial sequence
  Synthetic oligonucleotide
tagtctactatatacat

SEQ ID NO: 1347 - DNA, 18 bp, Artificial sequence
  Synthetic oligonucleotide
ctagtctactatatacat

SEQ ID NO: 1348 - DNA, 17 bp, Artificial sequence
  Synthetic oligonucleotide
ctagtctactatataca

SEQ ID NO: 1349 - DNA, 17 bp, Artificial sequence
  Synthetic oligonucleotide
actagtctactatatac

SEQ ID NO: 1350 - DNA, 16 bp, Artificial sequence
  Synthetic oligonucleotide
ctagtctactatatac

SEQ ID NO: 1351 - DNA, 17 bp, Artificial sequence
  Synthetic oligonucleotide
gtatattctacccataa

SEQ ID NO: 1352 - DNA, 18 bp, Artificial sequence
  Synthetic oligonucleotide
tgtatattctacccataa

SEQ ID NO: 1353 - DNA, 17 bp, Artificial sequence
  Synthetic oligonucleotide
tgtatattctacccata

SEQ ID NO: 1354 - DNA, 18 bp, Artificial sequence
  Synthetic oligonucleotide
atgtatattctacccata

SEQ ID NO: 1355 - DNA, 17 bp, Artificial sequence
  Synthetic oligonucleotide
atgtatattctacccat

SEQ ID NO: 1356 - DNA, 19 bp, Artificial sequence
  Synthetic oligonucleotide
gaaaaccacacaattccta

SEQ ID NO: 1357 - DNA, 18 bp, Artificial sequence
  Synthetic oligonucleotide
gaaaaccacacaattcct

SEQ ID NO: 1358 - DNA, 19 bp, Artificial sequence
  Synthetic oligonucleotide
agaaaaccacacaattcct

SEQ ID NO: 1359 - DNA, 19 bp, Artificial sequence
  Synthetic oligonucleotide
cagaaaaccacacaattcc

SEQ ID NO: 1360 - DNA, 18 bp, Artificial sequence
  Synthetic oligonucleotide
agaaaaccacacaattcc

SEQ ID NO: 1361 - DNA, 19 bp, Artificial sequence
  Synthetic oligonucleotide
ccagaaaaccacacaattc

SEQ ID NO: 1362 - DNA, 18 bp, Artificial sequence
  Synthetic oligonucleotide
ccagaaaaccacacaatt

SEQ ID NO: 1363 - DNA, 18 bp, Artificial sequence
  Synthetic oligonucleotide
tccagaaaaccacacaat

SEQ ID NO: 1364 - DNA, 18 bp, Artificial sequence
  Synthetic oligonucleotide
ttccagaaaaccacacaa

SEQ ID NO: 1365 - DNA, 19 bp, Artificial sequence
  Synthetic oligonucleotide
gatatatcactaaatccat

SEQ ID NO: 1366 - DNA, 18 bp, Artificial sequence
  Synthetic oligonucleotide
gatatatcactaaatcca

SEQ ID NO: 1367 - DNA, 19 bp, Artificial sequence
  Synthetic oligonucleotide
agatatatcactaaatcca

SEQ ID NO: 1368 - DNA, 18 bp, Artificial sequence
  Synthetic oligonucleotide
agatatatcactaaatcc

SEQ ID NO: 1369 - DNA, 19 bp, Artificial sequence
  Synthetic oligonucleotide
tcatatataaatttctcta

SEQ ID NO: 1370 - DNA, 18 bp, Artificial sequence
  Synthetic oligonucleotide
tcatatataaatttctct

SEQ ID NO: 1371 - DNA, 17 bp, Artificial sequence
  Synthetic oligonucleotide
aagatcacacaaccata

SEQ ID NO: 1372 - DNA, 18 bp, Artificial sequence
  Synthetic oligonucleotide
taaaagatcacacaacca

SEQ ID NO: 1373 - DNA, 20 bp, Artificial sequence
  Synthetic oligonucleotide
catcacataaaaacccactt

SEQ ID NO: 1374 - DNA, 19 bp, Artificial sequence
  Synthetic oligonucleotide
catcacataaaaacccact

SEQ ID NO: 1375 - DNA, 20 bp, Artificial sequence
  Synthetic oligonucleotide
tcatcacataaaaacccact

SEQ ID NO: 1376 - DNA, 18 bp, Artificial sequence
  Synthetic oligonucleotide
catcacataaaaacccac

SEQ ID NO: 1377 - DNA, 19 bp, Artificial sequence
  Synthetic oligonucleotide
tcatcacataaaaacccac

SEQ ID NO: 1378 - DNA, 20 bp, Artificial sequence
  Synthetic oligonucleotide
gtcatcacataaaaacccac

SEQ ID NO: 1379 - DNA, 19 bp, Artificial sequence
  Synthetic oligonucleotide
gtcatcacataaaaaccca

SEQ ID NO: 1380 - DNA, 18 bp, Artificial sequence
  Synthetic oligonucleotide
tcatcacataaaaaccca

SEQ ID NO: 1381 - DNA, 17 bp, Artificial sequence
  Synthetic oligonucleotide
catcacataaaaaccca

SEQ ID NO: 1382 - DNA, 17 bp, Artificial sequence
  Synthetic oligonucleotide
tcatcacataaaaaccc

SEQ ID NO: 1383 - DNA, 18 bp, Artificial sequence
  Synthetic oligonucleotide
gtcatcacataaaaaccc

SEQ ID NO: 1384 - DNA, 19 bp, Artificial sequence
  Synthetic oligonucleotide
agtcatcacataaaaaccc

SEQ ID NO: 1385 - DNA, 19 bp, Artificial sequence
  Synthetic oligonucleotide
tagtcatcacataaaaacc

SEQ ID NO: 1386 - DNA, 18 bp, Artificial sequence
  Synthetic oligonucleotide
agtcatcacataaaaacc

SEQ ID NO: 1387 - DNA, 17 bp, Artificial sequence
  Synthetic oligonucleotide
atgctaaatacaaatct

SEQ ID NO: 1388 - DNA, 20 bp, Artificial sequence
  Synthetic oligonucleotide
gaaaccattactacaaccaa

SEQ ID NO: 1389 - DNA, 19 bp, Artificial sequence
  Synthetic oligonucleotide
gaaaccattactacaacca

SEQ ID NO: 1390 - DNA, 19 bp, Artificial sequence
  Synthetic oligonucleotide
atgaaaccattactacaac

SEQ ID NO: 1391 - DNA, 18 bp, Artificial sequence
  Synthetic oligonucleotide
catgaaaccattactaca

SEQ ID NO: 1392 - DNA, 18 bp, Artificial sequence
  Synthetic oligonucleotide
ccatgaaaccattactac

SEQ ID NO: 1393 - DNA, 17 bp, Artificial sequence
  Synthetic oligonucleotide
ctcccatgaaaccatta

SEQ ID NO: 1394 - DNA, 18 bp, Artificial sequence
  Synthetic oligonucleotide
tgcttactttatacaaaa

SEQ ID NO: 1395 - DNA, 18 bp, Artificial sequence
  Synthetic oligonucleotide
atgttaatactttttcca

SEQ ID NO: 1396 - DNA, 17 bp, Artificial sequence
  Synthetic oligonucleotide
cctaatttaacccacaa

SEQ ID NO: 1397 - DNA, 19 bp, Artificial sequence
  Synthetic oligonucleotide
atcctaatttaacccacaa

SEQ ID NO: 1398 - DNA, 18 bp, Artificial sequence
  Synthetic oligonucleotide
tcctaatttaacccacaa

SEQ ID NO: 1399 - DNA, 21 bp, Artificial sequence
  Synthetic oligonucleotide
taatcctaatttaacccacaa

SEQ ID NO: 1400 - DNA, 20 bp, Artificial sequence
  Synthetic oligonucleotide
taatcctaatttaacccaca

SEQ ID NO: 1401 - DNA, 19 bp, Artificial sequence
  Synthetic oligonucleotide
aatcctaatttaacccaca

SEQ ID NO: 1402 - DNA, 17 bp, Artificial sequence
  Synthetic oligonucleotide
tcctaatttaacccaca

SEQ ID NO: 1403 - DNA, 19 bp, Artificial sequence
  Synthetic oligonucleotide
taatcctaatttaacccac

SEQ ID NO: 1404 - DNA, 17 bp, Artificial sequence
  Synthetic oligonucleotide
atcctaatttaacccac

SEQ ID NO: 1405 - DNA, 18 bp, Artificial sequence
  Synthetic oligonucleotide
aatcctaatttaacccac

SEQ ID NO: 1406 - DNA, 18 bp, Artificial sequence
  Synthetic oligonucleotide
taatcctaatttaaccca

SEQ ID NO: 1407 - DNA, 17 bp, Artificial sequence
  Synthetic oligonucleotide
aatcctaatttaaccca

SEQ ID NO: 1408 - DNA, 19 bp, Artificial sequence
  Synthetic oligonucleotide
gtaatcctaatttaaccca

SEQ ID NO: 1409 - DNA, 17 bp, Artificial sequence
  Synthetic oligonucleotide
taatcctaatttaaccc

SEQ ID NO: 1410 - DNA, 18 bp, Artificial sequence
  Synthetic oligonucleotide
gtaatcctaatttaaccc

SEQ ID NO: 1411 - DNA, 19 bp, Artificial sequence
  Synthetic oligonucleotide
agtaatcctaatttaaccc

SEQ ID NO: 1412 - DNA, 18 bp, Artificial sequence
  Synthetic oligonucleotide
agtaatcctaatttaacc

SEQ ID NO: 1413 - DNA, 18 bp, Artificial sequence
  Synthetic oligonucleotide
tcatttatcactaccaca

SEQ ID NO: 1414 - DNA, 20 bp, Artificial sequence
  Synthetic oligonucleotide
catcatttatcactaccaca

SEQ ID NO: 1415 - DNA, 17 bp, Artificial sequence
  Synthetic oligonucleotide
catttatcactaccaca

SEQ ID NO: 1416 - DNA, 19 bp, Artificial sequence
  Synthetic oligonucleotide
atcatttatcactaccaca

SEQ ID NO: 1417 - DNA, 21 bp, Artificial sequence
  Synthetic oligonucleotide
acatcatttatcactaccaca

SEQ ID NO: 1418 - DNA, 17 bp, Artificial sequence
  Synthetic oligonucleotide
tcatttatcactaccac

SEQ ID NO: 1419 - DNA, 18 bp, Artificial sequence
  Synthetic oligonucleotide
atcatttatcactaccac

SEQ ID NO: 1420 - DNA, 19 bp, Artificial sequence
  Synthetic oligonucleotide
catcatttatcactaccac

SEQ ID NO: 1421 - DNA, 21 bp, Artificial sequence
  Synthetic oligonucleotide
aacatcatttatcactaccac

SEQ ID NO: 1422 - DNA, 20 bp, Artificial sequence
  Synthetic oligonucleotide
aacatcatttatcactacca

SEQ ID NO: 1423 - DNA, 18 bp, Artificial sequence
  Synthetic oligonucleotide
catcatttatcactacca

SEQ ID NO: 1424 - DNA, 21 bp, Artificial sequence
  Synthetic oligonucleotide
taacatcatttatcactacca

SEQ ID NO: 1425 - DNA, 19 bp, Artificial sequence
  Synthetic oligonucleotide
acatcatttatcactacca

SEQ ID NO: 1426 - DNA, 20 bp, Artificial sequence
  Synthetic oligonucleotide
taacatcatttatcactacc

SEQ ID NO: 1427 - DNA, 18 bp, Artificial sequence
  Synthetic oligonucleotide
acatcatttatcactacc

SEQ ID NO: 1428 - DNA, 21 bp, Artificial sequence
  Synthetic oligonucleotide
ttaacatcatttatcactacc

SEQ ID NO: 1429 - DNA, 19 bp, Artificial sequence
  Synthetic oligonucleotide
aacatcatttatcactacc

SEQ ID NO: 1430 - DNA, 20 bp, Artificial sequence
  Synthetic oligonucleotide
ttaacatcatttatcactac

SEQ ID NO: 1431 - DNA, 19 bp, Artificial sequence
  Synthetic oligonucleotide
taacatcatttatcactac

SEQ ID NO: 1432 - DNA, 21 bp, Artificial sequence
  Synthetic oligonucleotide
attaacatcatttatcactac

SEQ ID NO: 1433 - DNA, 20 bp, Artificial sequence
  Synthetic oligonucleotide
attaacatcatttatcacta

SEQ ID NO: 1434 - DNA, 19 bp, Artificial sequence
  Synthetic oligonucleotide
ttaacatcatttatcacta

SEQ ID NO: 1435 - DNA, 21 bp, Artificial sequence
  Synthetic oligonucleotide
taattaacatcatttatcact

SEQ ID NO: 1436 - DNA, 21 bp, Artificial sequence
  Synthetic oligonucleotide
ctaattaacatcatttatcac

SEQ ID NO: 1437 - DNA, 21 bp, Artificial sequence
  Synthetic oligonucleotide
cctaattaacatcatttatca

SEQ ID NO: 1438 - DNA, 20 bp, Artificial sequence
  Synthetic oligonucleotide
ctaattaacatcatttatca

SEQ ID NO: 1439 - DNA, 20 bp, Artificial sequence
  Synthetic oligonucleotide
cctaattaacatcatttatc

SEQ ID NO: 1440 - DNA, 21 bp, Artificial sequence
  Synthetic oligonucleotide
ccctaattaacatcatttatc

SEQ ID NO: 1441 - DNA, 19 bp, Artificial sequence
  Synthetic oligonucleotide
cctaattaacatcatttat

SEQ ID NO: 1442 - DNA, 18 bp, Artificial sequence
  Synthetic oligonucleotide
cctaattaacatcattta

SEQ ID NO: 1443 - DNA, 19 bp, Artificial sequence
  Synthetic oligonucleotide
ccctaattaacatcattta

SEQ ID NO: 1444 - DNA, 19 bp, Artificial sequence
  Synthetic oligonucleotide
gccctaattaacatcattt

SEQ ID NO: 1445 - DNA, 18 bp, Artificial sequence
  Synthetic oligonucleotide
ccctaattaacatcattt

SEQ ID NO: 1446 - DNA, 16 bp, Artificial sequence
  Synthetic oligonucleotide
cggccctaattaacat

SEQ ID NO: 1447 - DNA, 15 bp, Artificial sequence
  Synthetic oligonucleotide
ctcggccctaattaa

SEQ ID NO: 1448 - DNA, 21 bp, Artificial sequence
  Synthetic oligonucleotide
cacatataacatataaacaca

SEQ ID NO: 1449 - DNA, 21 bp, Artificial sequence
  Synthetic oligonucleotide
tcacatataacatataaacac

SEQ ID NO: 1450 - DNA, 20 bp, Artificial sequence
  Synthetic oligonucleotide
actatcacatataacatata

SEQ ID NO: 1451 - DNA, 21 bp, Artificial sequence
  Synthetic oligonucleotide
cactatcacatataacatata

SEQ ID NO: 1452 - DNA, 20 bp, Artificial sequence
  Synthetic oligonucleotide
cactatcacatataacatat

SEQ ID NO: 1453 - DNA, 19 bp, Artificial sequence
  Synthetic oligonucleotide
cactatcacatataacata

SEQ ID NO: 1454 - DNA, 18 bp, Artificial sequence
  Synthetic oligonucleotide
cactatcacatataacat

SEQ ID NO: 1455 - DNA, 17 bp, Artificial sequence
  Synthetic oligonucleotide
cactatcacatataaca

SEQ ID NO: 1456 - DNA, 17 bp, Artificial sequence
  Synthetic oligonucleotide
caaagttttcccattac

SEQ ID NO: 1457 - DNA, 17 bp, Artificial sequence
  Synthetic oligonucleotide
acaaagttttcccatta

SEQ ID NO: 1458 - DNA, 17 bp, Artificial sequence
  Synthetic oligonucleotide
tcagtccaacataactc

SEQ ID NO: 1459 - DNA, 16 bp, Artificial sequence
  Synthetic oligonucleotide
cagtccaacataactc

SEQ ID NO: 1460 - DNA, 18 bp, Artificial sequence
  Synthetic oligonucleotide
atcagtccaacataactc

SEQ ID NO: 1461 - DNA, 17 bp, Artificial sequence
  Synthetic oligonucleotide
atcagtccaacataact

SEQ ID NO: 1462 - DNA, 21 bp, Artificial sequence
  Synthetic oligonucleotide
taaacattaaaccctcccaaa

SEQ ID NO: 1463 - DNA, 18 bp, Artificial sequence
  Synthetic oligonucleotide
aacattaaaccctcccaa

SEQ ID NO: 1464 - DNA, 20 bp, Artificial sequence
  Synthetic oligonucleotide
taaacattaaaccctcccaa

SEQ ID NO: 1465 - DNA, 19 bp, Artificial sequence
  Synthetic oligonucleotide
aaacattaaaccctcccaa

SEQ ID NO: 1466 - DNA, 21 bp, Artificial sequence
  Synthetic oligonucleotide
tataaacattaaaccctccca

SEQ ID NO: 1467 - DNA, 16 bp, Artificial sequence
  Synthetic oligonucleotide
aacattaaaccctccc

SEQ ID NO: 1468 - DNA, 17 bp, Artificial sequence
  Synthetic oligonucleotide
aaacattaaaccctccc

SEQ ID NO: 1469 - DNA, 18 bp, Artificial sequence
  Synthetic oligonucleotide
taaacattaaaccctccc

SEQ ID NO: 1470 - DNA, 19 bp, Artificial sequence
  Synthetic oligonucleotide
ataaacattaaaccctccc

SEQ ID NO: 1471 - DNA, 19 bp, Artificial sequence
  Synthetic oligonucleotide
tataaacattaaaccctcc

SEQ ID NO: 1472 - DNA, 17 bp, Artificial sequence
  Synthetic oligonucleotide
taaacattaaaccctcc

SEQ ID NO: 1473 - DNA, 21 bp, Artificial sequence
  Synthetic oligonucleotide
actataaacattaaaccctcc

SEQ ID NO: 1474 - DNA, 18 bp, Artificial sequence
  Synthetic oligonucleotide
ataaacattaaaccctcc

SEQ ID NO: 1475 - DNA, 21 bp, Artificial sequence
  Synthetic oligonucleotide
aactataaacattaaaccctc

SEQ ID NO: 1476 - DNA, 19 bp, Artificial sequence
  Synthetic oligonucleotide
ctataaacattaaaccctc

SEQ ID NO: 1477 - DNA, 20 bp, Artificial sequence
  Synthetic oligonucleotide
actataaacattaaaccctc

SEQ ID NO: 1478 - DNA, 21 bp, Artificial sequence
  Synthetic oligonucleotide
aaactataaacattaaaccct

SEQ ID NO: 1479 - DNA, 18 bp, Artificial sequence
  Synthetic oligonucleotide
ctataaacattaaaccct

SEQ ID NO: 1480 - DNA, 19 bp, Artificial sequence
  Synthetic oligonucleotide
actataaacattaaaccct

SEQ ID NO: 1481 - DNA, 20 bp, Artificial sequence
  Synthetic oligonucleotide
aactataaacattaaaccct

SEQ ID NO: 1482 - DNA, 19 bp, Artificial sequence
  Synthetic oligonucleotide
gctttaaactataaacatt

SEQ ID NO: 1483 - DNA, 18 bp, Artificial sequence
  Synthetic oligonucleotide
tgctttaaactataaaca

SEQ ID NO: 1484 - DNA, 17 bp, Artificial sequence
  Synthetic oligonucleotide
cagatttatcactatta

SEQ ID NO: 1485 - DNA, 17 bp, Artificial sequence
  Synthetic oligonucleotide
tcacagcctatcaccac

SEQ ID NO: 1486 - DNA, 17 bp, Artificial sequence
  Synthetic oligonucleotide
atcacagcctatcacca

SEQ ID NO: 1487 - DNA, 17 bp, Artificial sequence
  Synthetic oligonucleotide
aatcacagcctatcacc

SEQ ID NO: 1488 - DNA, 16 bp, Artificial sequence
  Synthetic oligonucleotide
atcacagcctatcacc

SEQ ID NO: 1489 - DNA, 16 bp, Artificial sequence
  Synthetic oligonucleotide
gcgtcacccaaatcac

SEQ ID NO: 1490 - DNA, 16 bp, Artificial sequence
  Synthetic oligonucleotide
agcgtcacccaaatca

SEQ ID NO: 1491 - DNA, 15 bp, Artificial sequence
  Synthetic oligonucleotide
agcgtcacccaaatc

SEQ ID NO: 1492 - DNA, 17 bp, Artificial sequence
  Synthetic oligonucleotide
cagatcctaaaatcact

SEQ ID NO: 1493 - DNA, 17 bp, Artificial sequence
  Synthetic oligonucleotide
tcagatcctaaaatcac

SEQ ID NO: 1494 - DNA, 18 bp, Artificial sequence
  Synthetic oligonucleotide
agtaaaaccaatcatcat

SEQ ID NO: 1495 - DNA, 17 bp, Artificial sequence
  Synthetic oligonucleotide
agtaaaaccaatcatca

SEQ ID NO: 1496 - DNA, 20 bp, Artificial sequence
  Synthetic oligonucleotide
cccttccatctctactaaaa

SEQ ID NO: 1497 - DNA, 20 bp, Artificial sequence
  Synthetic oligonucleotide
ataactacataacaaaccca

SEQ ID NO: 1498 - DNA, 21 bp, Artificial sequence
  Synthetic oligonucleotide
aataactacataacaaaccca

SEQ ID NO: 1499 - DNA, 18 bp, Artificial sequence
  Synthetic oligonucleotide
aactacataacaaaccca

SEQ ID NO: 1500 - DNA, 19 bp, Artificial sequence
  Synthetic oligonucleotide
taactacataacaaaccca

SEQ ID NO: 1501 - DNA, 17 bp, Artificial sequence
  Synthetic oligonucleotide
actacataacaaaccca

SEQ ID NO: 1502 - DNA, 21 bp, Artificial sequence
  Synthetic oligonucleotide
caataactacataacaaaccc

SEQ ID NO: 1503 - DNA, 19 bp, Artificial sequence
  Synthetic oligonucleotide
ataactacataacaaaccc

SEQ ID NO: 1504 - DNA, 21 bp, Artificial sequence
  Synthetic oligonucleotide
acaataactacataacaaacc

SEQ ID NO: 1505 - DNA, 19 bp, Artificial sequence
  Synthetic oligonucleotide
tgaattcacaataactaca

SEQ ID NO: 1506 - DNA, 18 bp, Artificial sequence
  Synthetic oligonucleotide
gcacatttttcttaaact

SEQ ID NO: 1507 - DNA, 19 bp, Artificial sequence
  Synthetic oligonucleotide
gctatacctaaaacaatct

SEQ ID NO: 1508 - DNA, 18 bp, Artificial sequence
  Synthetic oligonucleotide
gctatacctaaaacaatc

SEQ ID NO: 1509 - DNA, 17 bp, Artificial sequence
  Synthetic oligonucleotide
cccttgtaactaaaaat

SEQ ID NO: 1510 - DNA, 17 bp, Artificial sequence
  Synthetic oligonucleotide
ccccttgtaactaaaaa

SEQ ID NO: 1511 - DNA, 16 bp, Artificial sequence
  Synthetic oligonucleotide
ccccttgtaactaaaa

SEQ ID NO: 1512 - DNA, 16 bp, Artificial sequence
  Synthetic oligonucleotide
accccttgtaactaaa

SEQ ID NO: 1513 - DNA, 16 bp, Artificial sequence
  Synthetic oligonucleotide
caccccttgtaactaa

SEQ ID NO: 1514 - DNA, 16 bp, Artificial sequence
  Synthetic oligonucleotide
acaccccttgtaacta

SEQ ID NO: 1515 - DNA, 17 bp, Artificial sequence
  Synthetic oligonucleotide
gctaaaactaatcatct

SEQ ID NO: 1516 - DNA, 16 bp, Artificial sequence
  Synthetic oligonucleotide
ggctaaaactaatcat

SEQ ID NO: 1517 - DNA, 21 bp, Artificial sequence
  Synthetic oligonucleotide
ttacccttcatatatacatct

SEQ ID NO: 1518 - DNA, 21 bp, Artificial sequence
  Synthetic oligonucleotide
attacccttcatatatacatc

SEQ ID NO: 1519 - DNA, 20 bp, Artificial sequence
  Synthetic oligonucleotide
ttacccttcatatatacatc

SEQ ID NO: 1520 - DNA, 21 bp, Artificial sequence
  Synthetic oligonucleotide
cattacccttcatatatacat

SEQ ID NO: 1521 - DNA, 19 bp, Artificial sequence
  Synthetic oligonucleotide
ttacccttcatatatacat

SEQ ID NO: 1522 - DNA, 20 bp, Artificial sequence
  Synthetic oligonucleotide
attacccttcatatatacat

SEQ ID NO: 1523 - DNA, 21 bp, Artificial sequence
  Synthetic oligonucleotide
acattacccttcatatataca

SEQ ID NO: 1524 - DNA, 18 bp, Artificial sequence
  Synthetic oligonucleotide
ttacccttcatatataca

SEQ ID NO: 1525 - DNA, 20 bp, Artificial sequence
  Synthetic oligonucleotide
cattacccttcatatataca

SEQ ID NO: 1526 - DNA, 19 bp, Artificial sequence
  Synthetic oligonucleotide
attacccttcatatataca

SEQ ID NO: 1527 - DNA, 18 bp, Artificial sequence
  Synthetic oligonucleotide
attacccttcatatatac

SEQ ID NO: 1528 - DNA, 17 bp, Artificial sequence
  Synthetic oligonucleotide
ttacccttcatatatac

SEQ ID NO: 1529 - DNA, 19 bp, Artificial sequence
  Synthetic oligonucleotide
cattacccttcatatatac

SEQ ID NO: 1530 - DNA, 20 bp, Artificial sequence
  Synthetic oligonucleotide
acattacccttcatatatac

SEQ ID NO: 1531 - DNA, 21 bp, Artificial sequence
  Synthetic oligonucleotide
tacattacccttcatatatac

SEQ ID NO: 1532 - DNA, 18 bp, Artificial sequence
  Synthetic oligonucleotide
cattacccttcatatata

SEQ ID NO: 1533 - DNA, 20 bp, Artificial sequence
  Synthetic oligonucleotide
tacattacccttcatatata

SEQ ID NO: 1534 - DNA, 17 bp, Artificial sequence
  Synthetic oligonucleotide
attacccttcatatata

SEQ ID NO: 1535 - DNA, 19 bp, Artificial sequence
  Synthetic oligonucleotide
acattacccttcatatata

SEQ ID NO: 1536 - DNA, 17 bp, Artificial sequence
  Synthetic oligonucleotide
cattacccttcatatat

SEQ ID NO: 1537 - DNA, 18 bp, Artificial sequence
  Synthetic oligonucleotide
acattacccttcatatat

SEQ ID NO: 1538 - DNA, 19 bp, Artificial sequence
  Synthetic oligonucleotide
tacattacccttcatatat

SEQ ID NO: 1539 - DNA, 17 bp, Artificial sequence
  Synthetic oligonucleotide
acattacccttcatata

SEQ ID NO: 1540 - DNA, 18 bp, Artificial sequence
  Synthetic oligonucleotide
tacattacccttcatata

SEQ ID NO: 1541 - DNA, 17 bp, Artificial sequence
  Synthetic oligonucleotide
tacattacccttcatat

SEQ ID NO: 1542 - DNA, 17 bp, Artificial sequence
  Synthetic oligonucleotide
gattcttatacttacta

SEQ ID NO: 1543 - DNA, 17 bp, Artificial sequence
  Synthetic oligonucleotide
tgattcttatacttact

SEQ ID NO: 1544 - DNA, 18 bp, Artificial sequence
  Synthetic oligonucleotide
atgattcttatacttact

SEQ ID NO: 1545 - DNA, 17 bp, Artificial sequence
  Synthetic oligonucleotide
gcctcatttttaccttt

SEQ ID NO: 1546 - DNA, 17 bp, Artificial sequence
  Synthetic oligonucleotide
accaatcttctatttta

SEQ ID NO: 1547 - DNA, 19 bp, Artificial sequence
  Synthetic oligonucleotide
caaccaatcttctatttta

SEQ ID NO: 1548 - DNA, 19 bp, Artificial sequence
  Synthetic oligonucleotide
gcaaccaatcttctatttt

SEQ ID NO: 1549 - DNA, 18 bp, Artificial sequence
  Synthetic oligonucleotide
gcaaccaatcttctattt

SEQ ID NO: 1550 - DNA, 17 bp, Artificial sequence
  Synthetic oligonucleotide
gcaaccaatcttctatt

SEQ ID NO: 1551 - DNA, 18 bp, Artificial sequence
  Synthetic oligonucleotide
tgcaaccaatcttctatt

SEQ ID NO: 1552 - DNA, 17 bp, Artificial sequence
  Synthetic oligonucleotide
taactgcaaccaatctt

SEQ ID NO: 1553 - DNA, 18 bp, Artificial sequence
  Synthetic oligonucleotide
tgaatacaacacacatca

SEQ ID NO: 1554 - DNA, 19 bp, Artificial sequence
  Synthetic oligonucleotide
atgaatacaacacacatca

SEQ ID NO: 1555 - DNA, 19 bp, Artificial sequence
  Synthetic oligonucleotide
taaaaatataactactcct

SEQ ID NO: 1556 - DNA, 19 bp, Artificial sequence
  Synthetic oligonucleotide
gtaaaaatataactactcc

SEQ ID NO: 1557 - DNA, 17 bp, Artificial sequence
  Synthetic oligonucleotide
tcaactgatacccacaa

SEQ ID NO: 1558 - DNA, 18 bp, Artificial sequence
  Synthetic oligonucleotide
tgtcttaacatttttctt

SEQ ID NO: 1559 - DNA, 21 bp, Artificial sequence
  Synthetic oligonucleotide
ccacttcaaacttttaattaa

SEQ ID NO: 1560 - DNA, 20 bp, Artificial sequence
  Synthetic oligonucleotide
ccacttcaaacttttaatta

SEQ ID NO: 1561 - DNA, 21 bp, Artificial sequence
  Synthetic oligonucleotide
cccacttcaaacttttaatta

SEQ ID NO: 1562 - DNA, 19 bp, Artificial sequence
  Synthetic oligonucleotide
ccacttcaaacttttaatt

SEQ ID NO: 1563 - DNA, 20 bp, Artificial sequence
  Synthetic oligonucleotide
cccacttcaaacttttaatt

SEQ ID NO: 1564 - DNA, 21 bp, Artificial sequence
  Synthetic oligonucleotide
acccacttcaaacttttaatt

SEQ ID NO: 1565 - DNA, 18 bp, Artificial sequence
  Synthetic oligonucleotide
ccacttcaaacttttaat

SEQ ID NO: 1566 - DNA, 20 bp, Artificial sequence
  Synthetic oligonucleotide
acccacttcaaacttttaat

SEQ ID NO: 1567 - DNA, 21 bp, Artificial sequence
  Synthetic oligonucleotide
aacccacttcaaacttttaat

SEQ ID NO: 1568 - DNA, 18 bp, Artificial sequence
  Synthetic oligonucleotide
cccacttcaaacttttaa

SEQ ID NO: 1569 - DNA, 19 bp, Artificial sequence
  Synthetic oligonucleotide
acccacttcaaacttttaa

SEQ ID NO: 1570 - DNA, 17 bp, Artificial sequence
  Synthetic oligonucleotide
cccacttcaaactttta

SEQ ID NO: 1571 - DNA, 18 bp, Artificial sequence
  Synthetic oligonucleotide
acccacttcaaactttta

SEQ ID NO: 1572 - DNA, 19 bp, Artificial sequence
  Synthetic oligonucleotide
aacccacttcaaactttta

SEQ ID NO: 1573 - DNA, 17 bp, Artificial sequence
  Synthetic oligonucleotide
acccacttcaaactttt

SEQ ID NO: 1574 - DNA, 18 bp, Artificial sequence
  Synthetic oligonucleotide
aacccacttcaaactttt

SEQ ID NO: 1575 - DNA, 17 bp, Artificial sequence
  Synthetic oligonucleotide
aacccacttcaaacttt

SEQ ID NO: 1576 - DNA, 16 bp, Artificial sequence
  Synthetic oligonucleotide
ggactctattaatcaa

SEQ ID NO: 1577 - DNA, 17 bp, Artificial sequence
  Synthetic oligonucleotide
gaatattctactcttct

SEQ ID NO: 1578 - DNA, 18 bp, Artificial sequence
  Synthetic oligonucleotide
ctgtatttaccaattcaa

SEQ ID NO: 1579 - DNA, 17 bp, Artificial sequence
  Synthetic oligonucleotide
ctgtatttaccaattca

SEQ ID NO: 1580 - DNA, 18 bp, Artificial sequence
  Synthetic oligonucleotide
actgtatttaccaattca

SEQ ID NO: 1581 - DNA, 17 bp, Artificial sequence
  Synthetic oligonucleotide
actgtatttaccaattc

SEQ ID NO: 1582 - DNA, 17 bp, Artificial sequence
  Synthetic oligonucleotide
cactgtatttaccaatt

SEQ ID NO: 1583 - DNA, 17 bp, Artificial sequence
  Synthetic oligonucleotide
tcactgtatttaccaat

SEQ ID NO: 1584 - DNA, 21 bp, Artificial sequence
  Synthetic oligonucleotide
ccaactactttacttttcaaa

SEQ ID NO: 1585 - DNA, 20 bp, Artificial sequence
  Synthetic oligonucleotide
ccaactactttacttttcaa

SEQ ID NO: 1586 - DNA, 21 bp, Artificial sequence
  Synthetic oligonucleotide
accaactactttacttttcaa

SEQ ID NO: 1587 - DNA, 19 bp, Artificial sequence
  Synthetic oligonucleotide
ccaactactttacttttca

SEQ ID NO: 1588 - DNA, 21 bp, Artificial sequence
  Synthetic oligonucleotide
taccaactactttacttttca

SEQ ID NO: 1589 - DNA, 20 bp, Artificial sequence
  Synthetic oligonucleotide
accaactactttacttttca

SEQ ID NO: 1590 - DNA, 20 bp, Artificial sequence
  Synthetic oligonucleotide
taccaactactttacttttc

SEQ ID NO: 1591 - DNA, 19 bp, Artificial sequence
  Synthetic oligonucleotide
gtaccaactactttacttt

SEQ ID NO: 1592 - DNA, 18 bp, Artificial sequence
  Synthetic oligonucleotide
gtaccaactactttactt

SEQ ID NO: 1593 - DNA, 17 bp, Artificial sequence
  Synthetic oligonucleotide
gtaccaactactttact

SEQ ID NO: 1594 - DNA, 18 bp, Artificial sequence
  Synthetic oligonucleotide
tgtaccaactactttact

SEQ ID NO: 1595 - DNA, 18 bp, Artificial sequence
  Synthetic oligonucleotide
ttgtaccaactactttac

SEQ ID NO: 1596 - DNA, 16 bp, Artificial sequence
  Synthetic oligonucleotide
gtaccaactactttac

SEQ ID NO: 1597 - DNA, 17 bp, Artificial sequence
  Synthetic oligonucleotide
tgtaccaactactttac

SEQ ID NO: 1598 - DNA, 17 bp, Artificial sequence
  Synthetic oligonucleotide
ttgtaccaactacttta

SEQ ID NO: 1599 - DNA, 20 bp, Artificial sequence
  Synthetic oligonucleotide
atttcatttttcttttaata

SEQ ID NO: 1600 - DNA, 20 bp, Artificial sequence
  Synthetic oligonucleotide
cctaatttcatttttctttt

SEQ ID NO: 1601 - DNA, 20 bp, Artificial sequence
  Synthetic oligonucleotide
tcctaatttcatttttcttt

SEQ ID NO: 1602 - DNA, 21 bp, Artificial sequence
  Synthetic oligonucleotide
ttcttcattataccatcaaat

SEQ ID NO: 1603 - DNA, 21 bp, Artificial sequence
  Synthetic oligonucleotide
tttcttcattataccatcaaa

SEQ ID NO: 1604 - DNA, 21 bp, Artificial sequence
  Synthetic oligonucleotide
ttttcttcattataccatcaa

SEQ ID NO: 1605 - DNA, 18 bp, Artificial sequence
  Synthetic oligonucleotide
tcttcattataccatcaa

SEQ ID NO: 1606 - DNA, 20 bp, Artificial sequence
  Synthetic oligonucleotide
tttcttcattataccatcaa

SEQ ID NO: 1607 - DNA, 19 bp, Artificial sequence
  Synthetic oligonucleotide
ttcttcattataccatcaa

SEQ ID NO: 1608 - DNA, 21 bp, Artificial sequence
  Synthetic oligonucleotide
atattttcttcattataccat

SEQ ID NO: 1609 - DNA, 20 bp, Artificial sequence
  Synthetic oligonucleotide
atattttcttcattatacca

SEQ ID NO: 1610 - DNA, 21 bp, Artificial sequence
  Synthetic oligonucleotide
aatattttcttcattatacca

SEQ ID NO: 1611 - DNA, 21 bp, Artificial sequence
  Synthetic oligonucleotide
aaatattttcttcattatacc

SEQ ID NO: 1612 - DNA, 19 bp, Artificial sequence
  Synthetic oligonucleotide
atattttcttcattatacc

SEQ ID NO: 1613 - DNA, 20 bp, Artificial sequence
  Synthetic oligonucleotide
aatattttcttcattatacc

SEQ ID NO: 1614 - DNA, 20 bp, Artificial sequence
  Synthetic oligonucleotide
taaatattttcttcattata

SEQ ID NO: 1615 - DNA, 19 bp, Artificial sequence
  Synthetic oligonucleotide
ttttccttcatctacttct

SEQ ID NO: 1616 - DNA, 20 bp, Artificial sequence
  Synthetic oligonucleotide
attttccttcatctacttct

SEQ ID NO: 1617 - DNA, 20 bp, Artificial sequence
  Synthetic oligonucleotide
aattttccttcatctacttc

SEQ ID NO: 1618 - DNA, 18 bp, Artificial sequence
  Synthetic oligonucleotide
agaattttccttcatcta

SEQ ID NO: 1619 - DNA, 18 bp, Artificial sequence
  Synthetic oligonucleotide
cagaattttccttcatct

SEQ ID NO: 1620 - DNA, 18 bp, Artificial sequence
  Synthetic oligonucleotide
tcagaattttccttcatc

SEQ ID NO: 1621 - DNA, 18 bp, Artificial sequence
  Synthetic oligonucleotide
ctagaaatatctcacatt

SEQ ID NO: 1622 - DNA, 17 bp, Artificial sequence
  Synthetic oligonucleotide
ctagaaatatctcacat

SEQ ID NO: 1623 - DNA, 17 bp, Artificial sequence
  Synthetic oligonucleotide
actagaaatatctcaca

SEQ ID NO: 1624 - DNA, 17 bp, Artificial sequence
  Synthetic oligonucleotide
attagccattaatctat

SEQ ID NO: 1625 - DNA, 18 bp, Artificial sequence
  Synthetic oligonucleotide
ttgttacaaaataatcca

SEQ ID NO: 1626 - DNA, 19 bp, Artificial sequence
  Synthetic oligonucleotide
ttattttttacattaacta

SEQ ID NO: 1627 - DNA, 19 bp, Artificial sequence
  Synthetic oligonucleotide
tgccaaaatactaacatca

SEQ ID NO: 1628 - DNA, 18 bp, Artificial sequence
  Synthetic oligonucleotide
gccaaaatactaacatca

SEQ ID NO: 1629 - DNA, 18 bp, Artificial sequence
  Synthetic oligonucleotide
tgccaaaatactaacatc

SEQ ID NO: 1630 - DNA, 16 bp, Artificial sequence
  Synthetic oligonucleotide
gagtacaacacttaca

SEQ ID NO: 1631 - DNA, 18 bp, Artificial sequence
  Synthetic oligonucleotide
cacatccattcattttat

SEQ ID NO: 1632 - DNA, 19 bp, Artificial sequence
  Synthetic oligonucleotide
ccacatccattcattttat

SEQ ID NO: 1633 - DNA, 18 bp, Artificial sequence
  Synthetic oligonucleotide
ccacatccattcatttta

SEQ ID NO: 1634 - DNA, 18 bp, Artificial sequence
  Synthetic oligonucleotide
tatgccacatccattcat

SEQ ID NO: 1635 - DNA, 18 bp, Artificial sequence
  Synthetic oligonucleotide
ttatgccacatccattca

SEQ ID NO: 1636 - DNA, 17 bp, Artificial sequence
  Synthetic oligonucleotide
tatgccacatccattca

SEQ ID NO: 1637 - DNA, 17 bp, Artificial sequence
  Synthetic oligonucleotide
ttatgccacatccattc

SEQ ID NO: 1638 - DNA, 17 bp, Artificial sequence
  Synthetic oligonucleotide
attatgccacatccatt

SEQ ID NO: 1639 - DNA, 18 bp, Artificial sequence
  Synthetic oligonucleotide
agtttcatatttttaatc

SEQ ID NO: 1640 - DNA, 17 bp, Artificial sequence
  Synthetic oligonucleotide
atcactgcacactttcc

SEQ ID NO: 1641 - DNA, 18 bp, Artificial sequence
  Synthetic oligonucleotide
aagctctttccaaattct

SEQ ID NO: 1642 - DNA, 18 bp, Artificial sequence
  Synthetic oligonucleotide
tagttcttaactcttctc

SEQ ID NO: 1643 - DNA, 17 bp, Artificial sequence
  Synthetic oligonucleotide
ttagttcttaactcttc

SEQ ID NO: 1644 - DNA, 17 bp, Artificial sequence
  Synthetic oligonucleotide
agcttcaaatactcaaa

SEQ ID NO: 1645 - DNA, 17 bp, Artificial sequence
  Synthetic oligonucleotide
tttcaaagccacaccta

SEQ ID NO: 1646 - DNA, 19 bp, Artificial sequence
  Synthetic oligonucleotide
aatatcctcattacccatt

SEQ ID NO: 1647 - DNA, 17 bp, Artificial sequence
  Synthetic oligonucleotide
tatcctcattacccatt

SEQ ID NO: 1648 - DNA, 18 bp, Artificial sequence
  Synthetic oligonucleotide
atatcctcattacccatt

SEQ ID NO: 1649 - DNA, 18 bp, Artificial sequence
  Synthetic oligonucleotide
aatatcctcattacccat

SEQ ID NO: 1650 - DNA, 19 bp, Artificial sequence
  Synthetic oligonucleotide
taatatcctcattacccat

SEQ ID NO: 1651 - DNA, 20 bp, Artificial sequence
  Synthetic oligonucleotide
ttaatatcctcattacccat

SEQ ID NO: 1652 - DNA, 17 bp, Artificial sequence
  Synthetic oligonucleotide
atatcctcattacccat

SEQ ID NO: 1653 - DNA, 17 bp, Artificial sequence
  Synthetic oligonucleotide
aatatcctcattaccca

SEQ ID NO: 1654 - DNA, 18 bp, Artificial sequence
  Synthetic oligonucleotide
taatatcctcattaccca

SEQ ID NO: 1655 - DNA, 20 bp, Artificial sequence
  Synthetic oligonucleotide
tttaatatcctcattaccca

SEQ ID NO: 1656 - DNA, 19 bp, Artificial sequence
  Synthetic oligonucleotide
ttaatatcctcattaccca

SEQ ID NO: 1657 - DNA, 20 bp, Artificial sequence
  Synthetic oligonucleotide
atttaatatcctcattaccc

SEQ ID NO: 1658 - DNA, 17 bp, Artificial sequence
  Synthetic oligonucleotide
taatatcctcattaccc

SEQ ID NO: 1659 - DNA, 18 bp, Artificial sequence
  Synthetic oligonucleotide
ttaatatcctcattaccc

SEQ ID NO: 1660 - DNA, 19 bp, Artificial sequence
  Synthetic oligonucleotide
tttaatatcctcattaccc

SEQ ID NO: 1661 - DNA, 21 bp, Artificial sequence
  Synthetic oligonucleotide
aatttaatatcctcattaccc

SEQ ID NO: 1662 - DNA, 18 bp, Artificial sequence
  Synthetic oligonucleotide
tttaatatcctcattacc

SEQ ID NO: 1663 - DNA, 20 bp, Artificial sequence
  Synthetic oligonucleotide
aatttaatatcctcattacc

SEQ ID NO: 1664 - DNA, 17 bp, Artificial sequence
  Synthetic oligonucleotide
ttaatatcctcattacc

SEQ ID NO: 1665 - DNA, 21 bp, Artificial sequence
  Synthetic oligonucleotide
aaatttaatatcctcattacc

SEQ ID NO: 1666 - DNA, 19 bp, Artificial sequence
  Synthetic oligonucleotide
atttaatatcctcattacc

SEQ ID NO: 1667 - DNA, 21 bp, Artificial sequence
  Synthetic oligonucleotide
taaatttaatatcctcattac

SEQ ID NO: 1668 - DNA, 21 bp, Artificial sequence
  Synthetic oligonucleotide
ttaaatttaatatcctcatta

SEQ ID NO: 1669 - DNA, 21 bp, Artificial sequence
  Synthetic oligonucleotide
cttaaatttaatatcctcatt

SEQ ID NO: 1670 - DNA, 21 bp, Artificial sequence
  Synthetic oligonucleotide
tcttaaatttaatatcctcat

SEQ ID NO: 1671 - DNA, 20 bp, Artificial sequence
  Synthetic oligonucleotide
tcttaaatttaatatcctca

SEQ ID NO: 1672 - DNA, 21 bp, Artificial sequence
  Synthetic oligonucleotide
ttcttaaatttaatatcctca

SEQ ID NO: 1673 - DNA, 20 bp, Artificial sequence
  Synthetic oligonucleotide
ttcttaaatttaatatcctc

SEQ ID NO: 1674 - DNA, 19 bp, Artificial sequence
  Synthetic oligonucleotide
tcttaaatttaatatcctc

SEQ ID NO: 1675 - DNA, 19 bp, Artificial sequence
  Synthetic oligonucleotide
ttcttaaatttaatatcct

SEQ ID NO: 1676 - DNA, 18 bp, Artificial sequence
  Synthetic oligonucleotide
tcttaaatttaatatcct

SEQ ID NO: 1677 - DNA, 17 bp, Artificial sequence
  Synthetic oligonucleotide
aatagcctttattctac

SEQ ID NO: 1678 - DNA, 18 bp, Artificial sequence
  Synthetic oligonucleotide
cagcaacaattattaata

SEQ ID NO: 1679 - DNA, 18 bp, Artificial sequence
  Synthetic oligonucleotide
ccagcaacaattattaat

SEQ ID NO: 1680 - DNA, 18 bp, Artificial sequence
  Synthetic oligonucleotide
accagcaacaattattaa

SEQ ID NO: 1681 - DNA, 17 bp, Artificial sequence
  Synthetic oligonucleotide
accagcaacaattatta

SEQ ID NO: 1682 - DNA, 17 bp, Artificial sequence
  Synthetic oligonucleotide
taccagcaacaattatt

SEQ ID NO: 1683 - DNA, 20 bp, Artificial sequence
  Synthetic oligonucleotide
ccccaaatctaaaacacttc

SEQ ID NO: 1684 - DNA, 21 bp, Artificial sequence
  Synthetic oligonucleotide
aaccccaaatctaaaacactt

SEQ ID NO: 1685 - DNA, 19 bp, Artificial sequence
  Synthetic oligonucleotide
ccccaaatctaaaacactt

SEQ ID NO: 1686 - DNA, 20 bp, Artificial sequence
  Synthetic oligonucleotide
aaccccaaatctaaaacact

SEQ ID NO: 1687 - DNA, 19 bp, Artificial sequence
  Synthetic oligonucleotide
accccaaatctaaaacact

SEQ ID NO: 1688 - DNA, 18 bp, Artificial sequence
  Synthetic oligonucleotide
accccaaatctaaaacac

SEQ ID NO: 1689 - DNA, 19 bp, Artificial sequence
  Synthetic oligonucleotide
gcaaatattcacaaatcct

SEQ ID NO: 1690 - DNA, 21 bp, Artificial sequence
  Synthetic oligonucleotide
actatttaacacacattatca

SEQ ID NO: 1691 - DNA, 20 bp, Artificial sequence
  Synthetic oligonucleotide
ctatttaacacacattatca

SEQ ID NO: 1692 - DNA, 21 bp, Artificial sequence
  Synthetic oligonucleotide
tactatttaacacacattatc

SEQ ID NO: 1693 - DNA, 20 bp, Artificial sequence
  Synthetic oligonucleotide
actatttaacacacattatc

SEQ ID NO: 1694 - DNA, 20 bp, Artificial sequence
  Synthetic oligonucleotide
tactatttaacacacattat

SEQ ID NO: 1695 - DNA, 21 bp, Artificial sequence
  Synthetic oligonucleotide
ctactatttaacacacattat

SEQ ID NO: 1696 - DNA, 20 bp, Artificial sequence
  Synthetic oligonucleotide
ctactatttaacacacatta

SEQ ID NO: 1697 - DNA, 21 bp, Artificial sequence
  Synthetic oligonucleotide
actactatttaacacacatta

SEQ ID NO: 1698 - DNA, 19 bp, Artificial sequence
  Synthetic oligonucleotide
ctactatttaacacacatt

SEQ ID NO: 1699 - DNA, 20 bp, Artificial sequence
  Synthetic oligonucleotide
actactatttaacacacatt

SEQ ID NO: 1700 - DNA, 19 bp, Artificial sequence
  Synthetic oligonucleotide
actactatttaacacacat

SEQ ID NO: 1701 - DNA, 17 bp, Artificial sequence
  Synthetic oligonucleotide
ctactatttaacacaca

SEQ ID NO: 1702 - DNA, 18 bp, Artificial sequence
  Synthetic oligonucleotide
actactatttaacacaca

SEQ ID NO: 1703 - DNA, 17 bp, Artificial sequence
  Synthetic oligonucleotide
tatagacccttaatatt

SEQ ID NO: 1704 - DNA, 17 bp, Artificial sequence
  Synthetic oligonucleotide
ttatagacccttaatat

SEQ ID NO: 1705 - DNA, 21 bp, Artificial sequence
  Synthetic oligonucleotide
catcacaaaataacctatcat

SEQ ID NO: 1706 - DNA, 21 bp, Artificial sequence
  Synthetic oligonucleotide
tcatcacaaaataacctatca

SEQ ID NO: 1707 - DNA, 21 bp, Artificial sequence
  Synthetic oligonucleotide
ttcatcacaaaataacctatc

SEQ ID NO: 1708 - DNA, 19 bp, Artificial sequence
  Synthetic oligonucleotide
ttcatcacaaaataaccta

SEQ ID NO: 1709 - DNA, 20 bp, Artificial sequence
  Synthetic oligonucleotide
tttcatcacaaaataaccta

SEQ ID NO: 1710 - DNA, 18 bp, Artificial sequence
  Synthetic oligonucleotide
tcatcacaaaataaccta

SEQ ID NO: 1711 - DNA, 21 bp, Artificial sequence
  Synthetic oligonucleotide
ttttcatcacaaaataaccta

SEQ ID NO: 1712 - DNA, 21 bp, Artificial sequence
  Synthetic oligonucleotide
attttcatcacaaaataacct

SEQ ID NO: 1713 - DNA, 21 bp, Artificial sequence
  Synthetic oligonucleotide
tattttcatcacaaaataacc

SEQ ID NO: 1714 - DNA, 19 bp, Artificial sequence
  Synthetic oligonucleotide
gtattttcatcacaaaata

SEQ ID NO: 1715 - DNA, 16 bp, Artificial sequence
  Synthetic oligonucleotide
ttacctagatcactcc

SEQ ID NO: 1716 - DNA, 16 bp, Artificial sequence
  Synthetic oligonucleotide
cttacctagatcactc

SEQ ID NO: 1717 - DNA, 16 bp, Artificial sequence
  Synthetic oligonucleotide
ccttacctagatcact

SEQ ID NO: 1718 - DNA, 17 bp, Artificial sequence
  Synthetic oligonucleotide
taactgctccttaatcc

SEQ ID NO: 1719 - DNA, 17 bp, Artificial sequence
  Synthetic oligonucleotide
tctagcaatcctctcct

SEQ ID NO: 1720 - DNA, 17 bp, Artificial sequence
  Synthetic oligonucleotide
ttctagcaatcctctcc

SEQ ID NO: 1721 - DNA, 21 bp, Artificial sequence
  Synthetic oligonucleotide
ttttcacctactaatattcat

SEQ ID NO: 1722 - DNA, 20 bp, Artificial sequence
  Synthetic oligonucleotide
tttcacctactaatattcat

SEQ ID NO: 1723 - DNA, 19 bp, Artificial sequence
  Synthetic oligonucleotide
ttcacctactaatattcat

SEQ ID NO: 1724 - DNA, 18 bp, Artificial sequence
  Synthetic oligonucleotide
tcacctactaatattcat

SEQ ID NO: 1725 - DNA, 17 bp, Artificial sequence
  Synthetic oligonucleotide
tcacctactaatattca

SEQ ID NO: 1726 - DNA, 19 bp, Artificial sequence
  Synthetic oligonucleotide
tttcacctactaatattca

SEQ ID NO: 1727 - DNA, 20 bp, Artificial sequence
  Synthetic oligonucleotide
ttttcacctactaatattca

SEQ ID NO: 1728 - DNA, 21 bp, Artificial sequence
  Synthetic oligonucleotide
tttttcacctactaatattca

SEQ ID NO: 1729 - DNA, 18 bp, Artificial sequence
  Synthetic oligonucleotide
ttcacctactaatattca

SEQ ID NO: 1730 - DNA, 21 bp, Artificial sequence
  Synthetic oligonucleotide
atttttcacctactaatattc

SEQ ID NO: 1731 - DNA, 20 bp, Artificial sequence
  Synthetic oligonucleotide
tttttcacctactaatattc

SEQ ID NO: 1732 - DNA, 21 bp, Artificial sequence
  Synthetic oligonucleotide
tatttttcacctactaatatt

SEQ ID NO: 1733 - DNA, 20 bp, Artificial sequence
  Synthetic oligonucleotide
tatttttcacctactaatat

SEQ ID NO: 1734 - DNA, 21 bp, Artificial sequence
  Synthetic oligonucleotide
ttatttttcacctactaatat

SEQ ID NO: 1735 - DNA, 20 bp, Artificial sequence
  Synthetic oligonucleotide
ttatttttcacctactaata

SEQ ID NO: 1736 - DNA, 19 bp, Artificial sequence
  Synthetic oligonucleotide
tatttttcacctactaata

SEQ ID NO: 1737 - DNA, 21 bp, Artificial sequence
  Synthetic oligonucleotide
tttatttttcacctactaata

SEQ ID NO: 1738 - DNA, 19 bp, Artificial sequence
  Synthetic oligonucleotide
tttatttttcacctactaa

SEQ ID NO: 1739 - DNA, 18 bp, Artificial sequence
  Synthetic oligonucleotide
tttatttttcacctacta

SEQ ID NO: 1740 - DNA, 20 bp, Artificial sequence
  Synthetic oligonucleotide
ctcaacttctactactaatt

SEQ ID NO: 1741 - DNA, 21 bp, Artificial sequence
  Synthetic oligonucleotide
tctcaacttctactactaatt

SEQ ID NO: 1742 - DNA, 21 bp, Artificial sequence
  Synthetic oligonucleotide
ctctcaacttctactactaat

SEQ ID NO: 1743 - DNA, 19 bp, Artificial sequence
  Synthetic oligonucleotide
ctcaacttctactactaat

SEQ ID NO: 1744 - DNA, 20 bp, Artificial sequence
  Synthetic oligonucleotide
tctcaacttctactactaat

SEQ ID NO: 1745 - DNA, 21 bp, Artificial sequence
  Synthetic oligonucleotide
tctctcaacttctactactaa

SEQ ID NO: 1746 - DNA, 18 bp, Artificial sequence
  Synthetic oligonucleotide
ctcaacttctactactaa

SEQ ID NO: 1747 - DNA, 19 bp, Artificial sequence
  Synthetic oligonucleotide
tctcaacttctactactaa

SEQ ID NO: 1748 - DNA, 17 bp, Artificial sequence
  Synthetic oligonucleotide
ctcaacttctactacta

SEQ ID NO: 1749 - DNA, 21 bp, Artificial sequence
  Synthetic oligonucleotide
ttctctcaacttctactacta

SEQ ID NO: 1750 - DNA, 20 bp, Artificial sequence
  Synthetic oligonucleotide
tctctcaacttctactacta

SEQ ID NO: 1751 - DNA, 18 bp, Artificial sequence
  Synthetic oligonucleotide
tctcaacttctactacta

SEQ ID NO: 1752 - DNA, 19 bp, Artificial sequence
  Synthetic oligonucleotide
ctctcaacttctactacta

SEQ ID NO: 1753 - DNA, 18 bp, Artificial sequence
  Synthetic oligonucleotide
ctctcaacttctactact

SEQ ID NO: 1754 - DNA, 17 bp, Artificial sequence
  Synthetic oligonucleotide
tctcaacttctactact

SEQ ID NO: 1755 - DNA, 19 bp, Artificial sequence
  Synthetic oligonucleotide
tctctcaacttctactact

SEQ ID NO: 1756 - DNA, 21 bp, Artificial sequence
  Synthetic oligonucleotide
tttctctcaacttctactact

SEQ ID NO: 1757 - DNA, 20 bp, Artificial sequence
  Synthetic oligonucleotide
ttctctcaacttctactact

SEQ ID NO: 1758 - DNA, 20 bp, Artificial sequence
  Synthetic oligonucleotide
tttctctcaacttctactac

SEQ ID NO: 1759 - DNA, 17 bp, Artificial sequence
  Synthetic oligonucleotide
ctctcaacttctactac

SEQ ID NO: 1760 - DNA, 19 bp, Artificial sequence
  Synthetic oligonucleotide
ttctctcaacttctactac

SEQ ID NO: 1761 - DNA, 21 bp, Artificial sequence
  Synthetic oligonucleotide
ttttctctcaacttctactac

SEQ ID NO: 1762 - DNA, 18 bp, Artificial sequence
  Synthetic oligonucleotide
tctctcaacttctactac

SEQ ID NO: 1763 - DNA, 19 bp, Artificial sequence
  Synthetic oligonucleotide
tttctctcaacttctacta

SEQ ID NO: 1764 - DNA, 20 bp, Artificial sequence
  Synthetic oligonucleotide
ttttctctcaacttctacta

SEQ ID NO: 1765 - DNA, 21 bp, Artificial sequence
  Synthetic oligonucleotide
tttttctctcaacttctacta

SEQ ID NO: 1766 - DNA, 17 bp, Artificial sequence
  Synthetic oligonucleotide
tctctcaacttctacta

SEQ ID NO: 1767 - DNA, 18 bp, Artificial sequence
  Synthetic oligonucleotide
ttctctcaacttctacta

SEQ ID NO: 1768 - DNA, 18 bp, Artificial sequence
  Synthetic oligonucleotide
tttctctcaacttctact

SEQ ID NO: 1769 - DNA, 19 bp, Artificial sequence
  Synthetic oligonucleotide
ttttctctcaacttctact

SEQ ID NO: 1770 - DNA, 21 bp, Artificial sequence
  Synthetic oligonucleotide
ctttttctctcaacttctact

SEQ ID NO: 1771 - DNA, 20 bp, Artificial sequence
  Synthetic oligonucleotide
tttttctctcaacttctact

SEQ ID NO: 1772 - DNA, 20 bp, Artificial sequence
  Synthetic oligonucleotide
ctttttctctcaacttctac

SEQ ID NO: 1773 - DNA, 21 bp, Artificial sequence
  Synthetic oligonucleotide
actttttctctcaacttctac

SEQ ID NO: 1774 - DNA, 18 bp, Artificial sequence
  Synthetic oligonucleotide
ttttctctcaacttctac

SEQ ID NO: 1775 - DNA, 19 bp, Artificial sequence
  Synthetic oligonucleotide
tttttctctcaacttctac

SEQ ID NO: 1776 - DNA, 19 bp, Artificial sequence
  Synthetic oligonucleotide
ctttttctctcaacttcta

SEQ ID NO: 1777 - DNA, 21 bp, Artificial sequence
  Synthetic oligonucleotide
tactttttctctcaacttcta

SEQ ID NO: 1778 - DNA, 20 bp, Artificial sequence
  Synthetic oligonucleotide
actttttctctcaacttcta

SEQ ID NO: 1779 - DNA, 18 bp, Artificial sequence
  Synthetic oligonucleotide
tttttctctcaacttcta

SEQ ID NO: 1780 - DNA, 20 bp, Artificial sequence
  Synthetic oligonucleotide
tactttttctctcaacttct

SEQ ID NO: 1781 - DNA, 21 bp, Artificial sequence
  Synthetic oligonucleotide
ttactttttctctcaacttct

SEQ ID NO: 1782 - DNA, 20 bp, Artificial sequence
  Synthetic oligonucleotide
ttactttttctctcaacttc

SEQ ID NO: 1783 - DNA, 19 bp, Artificial sequence
  Synthetic oligonucleotide
tactttttctctcaacttc

SEQ ID NO: 1784 - DNA, 18 bp, Artificial sequence
  Synthetic oligonucleotide
actttttctctcaacttc

SEQ ID NO: 1785 - DNA, 19 bp, Artificial sequence
  Synthetic oligonucleotide
ttactttttctctcaactt

SEQ ID NO: 1786 - DNA, 18 bp, Artificial sequence
  Synthetic oligonucleotide
tactttttctctcaactt

SEQ ID NO: 1787 - DNA, 18 bp, Artificial sequence
  Synthetic oligonucleotide
ttactttttctctcaact

SEQ ID NO: 1788 - DNA, 19 bp, Artificial sequence
  Synthetic oligonucleotide
gttactttttctctcaact

SEQ ID NO: 1789 - DNA, 18 bp, Artificial sequence
  Synthetic oligonucleotide
gttactttttctctcaac

SEQ ID NO: 1790 - DNA, 17 bp, Artificial sequence
  Synthetic oligonucleotide
gttactttttctctcaa

SEQ ID NO: 1791 - DNA, 18 bp, Artificial sequence
  Synthetic oligonucleotide
agttactttttctctcaa

SEQ ID NO: 1792 - DNA, 20 bp, Artificial sequence
  Synthetic oligonucleotide
cttttacattcccattaaca

SEQ ID NO: 1793 - DNA, 21 bp, Artificial sequence
  Synthetic oligonucleotide
cacttttacattcccattaac

SEQ ID NO: 1794 - DNA, 19 bp, Artificial sequence
  Synthetic oligonucleotide
cttttacattcccattaac

SEQ ID NO: 1795 - DNA, 20 bp, Artificial sequence
  Synthetic oligonucleotide
acttttacattcccattaac

SEQ ID NO: 1796 - DNA, 19 bp, Artificial sequence
  Synthetic oligonucleotide
acttttacattcccattaa

SEQ ID NO: 1797 - DNA, 18 bp, Artificial sequence
  Synthetic oligonucleotide
cttttacattcccattaa

SEQ ID NO: 1798 - DNA, 20 bp, Artificial sequence
  Synthetic oligonucleotide
cacttttacattcccattaa

SEQ ID NO: 1799 - DNA, 21 bp, Artificial sequence
  Synthetic oligonucleotide
tacacttttacattcccatta

SEQ ID NO: 1800 - DNA, 18 bp, Artificial sequence
  Synthetic oligonucleotide
acttttacattcccatta

SEQ ID NO: 1801 - DNA, 19 bp, Artificial sequence
  Synthetic oligonucleotide
cacttttacattcccatta

SEQ ID NO: 1802 - DNA, 20 bp, Artificial sequence
  Synthetic oligonucleotide
acacttttacattcccatta

SEQ ID NO: 1803 - DNA, 18 bp, Artificial sequence
  Synthetic oligonucleotide
cacttttacattcccatt

SEQ ID NO: 1804 - DNA, 20 bp, Artificial sequence
  Synthetic oligonucleotide
tacacttttacattcccatt

SEQ ID NO: 1805 - DNA, 19 bp, Artificial sequence
  Synthetic oligonucleotide
acacttttacattcccatt

SEQ ID NO: 1806 - DNA, 19 bp, Artificial sequence
  Synthetic oligonucleotide
tacacttttacattcccat

SEQ ID NO: 1807 - DNA, 18 bp, Artificial sequence
  Synthetic oligonucleotide
tacacttttacattccca

SEQ ID NO: 1808 - DNA, 19 bp, Artificial sequence
  Synthetic oligonucleotide
gtacacttttacattccca

SEQ ID NO: 1809 - DNA, 18 bp, Artificial sequence
  Synthetic oligonucleotide
gtacacttttacattccc

SEQ ID NO: 1810 - DNA, 17 bp, Artificial sequence
  Synthetic oligonucleotide
tacacttttacattccc

SEQ ID NO: 1811 - DNA, 19 bp, Artificial sequence
  Synthetic oligonucleotide
tgtacacttttacattccc

SEQ ID NO: 1812 - DNA, 18 bp, Artificial sequence
  Synthetic oligonucleotide
tgtacacttttacattcc

SEQ ID NO: 1813 - DNA, 18 bp, Artificial sequence
  Synthetic oligonucleotide
ctgtacacttttacattc

SEQ ID NO: 1814 - DNA, 18 bp, Artificial sequence
  Synthetic oligonucleotide
atcttatttacatcttcc

SEQ ID NO: 1815 - DNA, 19 bp, Artificial sequence
  Synthetic oligonucleotide
gaatcttatttacatcttc

SEQ ID NO: 1816 - DNA, 18 bp, Artificial sequence
  Synthetic oligonucleotide
gaatcttatttacatctt

SEQ ID NO: 1817 - DNA, 18 bp, Artificial sequence
  Synthetic oligonucleotide
tgaatcttatttacatct

SEQ ID NO: 1818 - DNA, 17 bp, Artificial sequence
  Synthetic oligonucleotide
attcagctttttcaatc

SEQ ID NO: 1819 - DNA, 20 bp, Artificial sequence
  Synthetic oligonucleotide
ttaattttcccttcactcct

SEQ ID NO: 1820 - DNA, 19 bp, Artificial sequence
  Synthetic oligonucleotide
ttaattttcccttcactcc

SEQ ID NO: 1821 - DNA, 18 bp, Artificial sequence
  Synthetic oligonucleotide
ttaattttcccttcactc

SEQ ID NO: 1822 - DNA, 19 bp, Artificial sequence
  Synthetic oligonucleotide
gttaattttcccttcactc

SEQ ID NO: 1823 - DNA, 21 bp, Artificial sequence
  Synthetic oligonucleotide
caaaattacttcttttatcat

SEQ ID NO: 1824 - DNA, 21 bp, Artificial sequence
  Synthetic oligonucleotide
ccaaaattacttcttttatca

SEQ ID NO: 1825 - DNA, 21 bp, Artificial sequence
  Synthetic oligonucleotide
tccaaaattacttcttttatc

SEQ ID NO: 1826 - DNA, 20 bp, Artificial sequence
  Synthetic oligonucleotide
tccaaaattacttcttttat

SEQ ID NO: 1827 - DNA, 19 bp, Artificial sequence
  Synthetic oligonucleotide
ccaaaattacttcttttat

SEQ ID NO: 1828 - DNA, 21 bp, Artificial sequence
  Synthetic oligonucleotide
ttccaaaattacttcttttat

SEQ ID NO: 1829 - DNA, 19 bp, Artificial sequence
  Synthetic oligonucleotide
tccaaaattacttctttta

SEQ ID NO: 1830 - DNA, 20 bp, Artificial sequence
  Synthetic oligonucleotide
ttccaaaattacttctttta

SEQ ID NO: 1831 - DNA, 19 bp, Artificial sequence
  Synthetic oligonucleotide
gttccaaaattacttcttt

SEQ ID NO: 1832 - DNA, 18 bp, Artificial sequence
  Synthetic oligonucleotide
gttccaaaattacttctt

SEQ ID NO: 1833 - DNA, 18 bp, Artificial sequence
  Synthetic oligonucleotide
tgttccaaaattacttct

SEQ ID NO: 1834 - DNA, 18 bp, Artificial sequence
  Synthetic oligonucleotide
atgttccaaaattacttc

SEQ ID NO: 1835 - DNA, 20 bp, Artificial sequence
  Synthetic oligonucleotide
catattttactctttttatt

SEQ ID NO: 1836 - DNA, 20 bp, Artificial sequence
  Synthetic oligonucleotide
ccatattttactctttttat

SEQ ID NO: 1837 - DNA, 21 bp, Artificial sequence
  Synthetic oligonucleotide
cccatattttactctttttat

SEQ ID NO: 1838 - DNA, 19 bp, Artificial sequence
  Synthetic oligonucleotide
catattttactctttttat

SEQ ID NO: 1839 - DNA, 20 bp, Artificial sequence
  Synthetic oligonucleotide
cccatattttactcttttta

SEQ ID NO: 1840 - DNA, 19 bp, Artificial sequence
  Synthetic oligonucleotide
ccatattttactcttttta

SEQ ID NO: 1841 - DNA, 21 bp, Artificial sequence
  Synthetic oligonucleotide
acccatattttactcttttta

SEQ ID NO: 1842 - DNA, 18 bp, Artificial sequence
  Synthetic oligonucleotide
ccatattttactcttttt

SEQ ID NO: 1843 - DNA, 19 bp, Artificial sequence
  Synthetic oligonucleotide
cccatattttactcttttt

SEQ ID NO: 1844 - DNA, 20 bp, Artificial sequence
  Synthetic oligonucleotide
acccatattttactcttttt

SEQ ID NO: 1845 - DNA, 21 bp, Artificial sequence
  Synthetic oligonucleotide
tacccatattttactcttttt

SEQ ID NO: 1846 - DNA, 20 bp, Artificial sequence
  Synthetic oligonucleotide
tacccatattttactctttt

SEQ ID NO: 1847 - DNA, 18 bp, Artificial sequence
  Synthetic oligonucleotide
cccatattttactctttt

SEQ ID NO: 1848 - DNA, 19 bp, Artificial sequence
  Synthetic oligonucleotide
acccatattttactctttt

SEQ ID NO: 1849 - DNA, 21 bp, Artificial sequence
  Synthetic oligonucleotide
ttacccatattttactctttt

SEQ ID NO: 1850 - DNA, 19 bp, Artificial sequence
  Synthetic oligonucleotide
tacccatattttactcttt

SEQ ID NO: 1851 - DNA, 18 bp, Artificial sequence
  Synthetic oligonucleotide
acccatattttactcttt

SEQ ID NO: 1852 - DNA, 20 bp, Artificial sequence
  Synthetic oligonucleotide
ttacccatattttactcttt

SEQ ID NO: 1853 - DNA, 21 bp, Artificial sequence
  Synthetic oligonucleotide
tttacccatattttactcttt

SEQ ID NO: 1854 - DNA, 19 bp, Artificial sequence
  Synthetic oligonucleotide
ttacccatattttactctt

SEQ ID NO: 1855 - DNA, 20 bp, Artificial sequence
  Synthetic oligonucleotide
tttacccatattttactctt

SEQ ID NO: 1856 - DNA, 17 bp, Artificial sequence
  Synthetic oligonucleotide
acccatattttactctt

SEQ ID NO: 1857 - DNA, 18 bp, Artificial sequence
  Synthetic oligonucleotide
tacccatattttactctt

SEQ ID NO: 1858 - DNA, 17 bp, Artificial sequence
  Synthetic oligonucleotide
tacccatattttactct

SEQ ID NO: 1859 - DNA, 18 bp, Artificial sequence
  Synthetic oligonucleotide
ttacccatattttactct

SEQ ID NO: 1860 - DNA, 19 bp, Artificial sequence
  Synthetic oligonucleotide
tttacccatattttactct

SEQ ID NO: 1861 - DNA, 17 bp, Artificial sequence
  Synthetic oligonucleotide
ttacccatattttactc

SEQ ID NO: 1862 - DNA, 18 bp, Artificial sequence
  Synthetic oligonucleotide
tttacccatattttactc

SEQ ID NO: 1863 - DNA, 19 bp, Artificial sequence
  Synthetic oligonucleotide
gtttacccatattttactc

SEQ ID NO: 1864 - DNA, 18 bp, Artificial sequence
  Synthetic oligonucleotide
gtttacccatattttact

SEQ ID NO: 1865 - DNA, 18 bp, Artificial sequence
  Synthetic oligonucleotide
tgtttacccatattttac

SEQ ID NO: 1866 - DNA, 17 bp, Artificial sequence
  Synthetic oligonucleotide
gtttacccatattttac

SEQ ID NO: 1867 - DNA, 17 bp, Artificial sequence
  Synthetic oligonucleotide
tgtttacccatatttta

SEQ ID NO: 1868 - DNA, 17 bp, Artificial sequence
  Synthetic oligonucleotide
ttcttgcttcaaccatc

SEQ ID NO: 1869 - DNA, 17 bp, Artificial sequence
  Synthetic oligonucleotide
gttacctccctttatat

SEQ ID NO: 1870 - DNA, 16 bp, Artificial sequence
  Synthetic oligonucleotide
ggttacctccctttat

SEQ ID NO: 1871 - DNA, 16 bp, Artificial sequence
  Synthetic oligonucleotide
aggttacctcccttta

SEQ ID NO: 1872 - DNA, 18 bp, Artificial sequence
  Synthetic oligonucleotide
atgttctctatctctata

SEQ ID NO: 1873 - DNA, 17 bp, Artificial sequence
  Synthetic oligonucleotide
tatgttctctatctcta

SEQ ID NO: 1874 - DNA, 17 bp, Artificial sequence
  Synthetic oligonucleotide
agatcaaactaaaacct

SEQ ID NO: 1875 - DNA, 17 bp, Artificial sequence
  Synthetic oligonucleotide
tgcccaatttcacccaa

SEQ ID NO: 1876 - DNA, 17 bp, Artificial sequence
  Synthetic oligonucleotide
tttgcccaatttcaccc

SEQ ID NO: 1877 - DNA, 17 bp, Artificial sequence
  Synthetic oligonucleotide
ttttgcccaatttcacc

SEQ ID NO: 1878 - DNA, 18 bp, Artificial sequence
  Synthetic oligonucleotide
tgtatatcaacaattcat

SEQ ID NO: 1879 - DNA, 20 bp, Artificial sequence
  Synthetic oligonucleotide
acatttctttaaaatttcca

SEQ ID NO: 1880 - DNA, 21 bp, Artificial sequence
  Synthetic oligonucleotide
cacatttctttaaaatttcca

SEQ ID NO: 1881 - DNA, 21 bp, Artificial sequence
  Synthetic oligonucleotide
ccacatttctttaaaatttcc

SEQ ID NO: 1882 - DNA, 20 bp, Artificial sequence
  Synthetic oligonucleotide
cacatttctttaaaatttcc

SEQ ID NO: 1883 - DNA, 19 bp, Artificial sequence
  Synthetic oligonucleotide
acatttctttaaaatttcc

SEQ ID NO: 1884 - DNA, 20 bp, Artificial sequence
  Synthetic oligonucleotide
ccacatttctttaaaatttc

SEQ ID NO: 1885 - DNA, 21 bp, Artificial sequence
  Synthetic oligonucleotide
accacatttctttaaaatttc

SEQ ID NO: 1886 - DNA, 20 bp, Artificial sequence
  Synthetic oligonucleotide
accacatttctttaaaattt

SEQ ID NO: 1887 - DNA, 20 bp, Artificial sequence
  Synthetic oligonucleotide
acaaaaccacatttctttaa

SEQ ID NO: 1888 - DNA, 18 bp, Artificial sequence
  Synthetic oligonucleotide
ctgttttcaaatcatttc

SEQ ID NO: 1889 - DNA, 19 bp, Artificial sequence
  Synthetic oligonucleotide
gaaccattactattatcaa

SEQ ID NO: 1890 - DNA, 19 bp, Artificial sequence
  Synthetic oligonucleotide
agaaccattactattatca

SEQ ID NO: 1891 - DNA, 18 bp, Artificial sequence
  Synthetic oligonucleotide
agaaccattactattatc

SEQ ID NO: 1892 - DNA, 18 bp, Artificial sequence
  Synthetic oligonucleotide
ctagaaccattactatta

SEQ ID NO: 1893 - DNA, 17 bp, Artificial sequence
  Synthetic oligonucleotide
tagaaccattactatta

SEQ ID NO: 1894 - DNA, 17 bp, Artificial sequence
  Synthetic oligonucleotide
ctagaaccattactatt

SEQ ID NO: 1895 - DNA, 19 bp, Artificial sequence
  Synthetic oligonucleotide
agattaccatctttcaaaa

SEQ ID NO: 1896 - DNA, 18 bp, Artificial sequence
  Synthetic oligonucleotide
agattaccatctttcaaa

SEQ ID NO: 1897 - DNA, 17 bp, Artificial sequence
  Synthetic oligonucleotide
agattaccatctttcaa

SEQ ID NO: 1898 - DNA, 17 bp, Artificial sequence
  Synthetic oligonucleotide
aagattaccatctttca

SEQ ID NO: 1899 - DNA, 18 bp, Artificial sequence
  Synthetic oligonucleotide
catgctcacacattttaa

SEQ ID NO: 1900 - DNA, 17 bp, Artificial sequence
  Synthetic oligonucleotide
cttaagctatctaaaca

SEQ ID NO: 1901 - DNA, 18 bp, Artificial sequence
  Synthetic oligonucleotide
tgaacaattcaacattca

SEQ ID NO: 1902 - DNA, 18 bp, Artificial sequence
  Synthetic oligonucleotide
gatcaaaaaactttccct

SEQ ID NO: 1903 - DNA, 19 bp, Artificial sequence
  Synthetic oligonucleotide
agatcaaaaaactttccct

SEQ ID NO: 1904 - DNA, 18 bp, Artificial sequence
  Synthetic oligonucleotide
agatcaaaaaactttccc

SEQ ID NO: 1905 - DNA, 17 bp, Artificial sequence
  Synthetic oligonucleotide
tcctagatcaaaaaact

SEQ ID NO: 1906 - DNA, 19 bp, Artificial sequence
  Synthetic oligonucleotide
attttttcttctcttttca

SEQ ID NO: 1907 - DNA, 20 bp, Artificial sequence
  Synthetic oligonucleotide
tattttttcttctcttttca

SEQ ID NO: 1908 - DNA, 20 bp, Artificial sequence
  Synthetic oligonucleotide
atattttttcttctcttttc

SEQ ID NO: 1909 - DNA, 18 bp, Artificial sequence
  Synthetic oligonucleotide
tctgctttaaaaactctc

SEQ ID NO: 1910 - DNA, 17 bp, Artificial sequence
  Synthetic oligonucleotide
ctctgctttaaaaactc

SEQ ID NO: 1911 - DNA, 19 bp, Artificial sequence
  Synthetic oligonucleotide
actacacaaacacattcaa

SEQ ID NO: 1912 - DNA, 21 bp, Artificial sequence
  Synthetic oligonucleotide
caaactacacaaacacattca

SEQ ID NO: 1913 - DNA, 21 bp, Artificial sequence
  Synthetic oligonucleotide
acaaactacacaaacacattc

SEQ ID NO: 1914 - DNA, 21 bp, Artificial sequence
  Synthetic oligonucleotide
caacaaactacacaaacacat

SEQ ID NO: 1915 - DNA, 21 bp, Artificial sequence
  Synthetic oligonucleotide
cacaacaaactacacaaacac

SEQ ID NO: 1916 - DNA, 21 bp, Artificial sequence
  Synthetic oligonucleotide
tcacaacaaactacacaaaca

SEQ ID NO: 1917 - DNA, 21 bp, Artificial sequence
  Synthetic oligonucleotide
ttcacaacaaactacacaaac

SEQ ID NO: 1918 - DNA, 21 bp, Artificial sequence
  Synthetic oligonucleotide
atttcacaacaaactacacaa

SEQ ID NO: 1919 - DNA, 21 bp, Artificial sequence
  Synthetic oligonucleotide
caatttcacaacaaactacac

SEQ ID NO: 1920 - DNA, 19 bp, Artificial sequence
  Synthetic oligonucleotide
tgtaacaatttcacaacaa

SEQ ID NO: 1921 - DNA, 18 bp, Artificial sequence
  Synthetic oligonucleotide
tgtaacaatttcacaaca

SEQ ID NO: 1922 - DNA, 17 bp, Artificial sequence
  Synthetic oligonucleotide
ttaagccaaccccacca

SEQ ID NO: 1923 - DNA, 17 bp, Artificial sequence
  Synthetic oligonucleotide
tttaagccaaccccacc

SEQ ID NO: 1924 - DNA, 17 bp, Artificial sequence
  Synthetic oligonucleotide
atttaagccaaccccac

SEQ ID NO: 1925 - DNA, 18 bp, Artificial sequence
  Synthetic oligonucleotide
ccagtaatacaaattata

SEQ ID NO: 1926 - DNA, 17 bp, Artificial sequence
  Synthetic oligonucleotide
cccagtaatacaaatta

SEQ ID NO: 1927 - DNA, 17 bp, Artificial sequence
  Synthetic oligonucleotide
tcccagtaatacaaatt

SEQ ID NO: 1928 - DNA, 17 bp, Artificial sequence
  Synthetic oligonucleotide
atcccagtaatacaaat

SEQ ID NO: 1929 - DNA, 17 bp, Artificial sequence
  Synthetic oligonucleotide
ctactagcatcaccact

SEQ ID NO: 1930 - DNA, 16 bp, Artificial sequence
  Synthetic oligonucleotide
ttctactagcatcacc

SEQ ID NO: 1931 - DNA, 16 bp, Artificial sequence
  Synthetic oligonucleotide
cttctactagcatcac

SEQ ID NO: 1932 - DNA, 21 bp, Artificial sequence
  Synthetic oligonucleotide
taaattactcattaaatccat

SEQ ID NO: 1933 - DNA, 21 bp, Artificial sequence
  Synthetic oligonucleotide
ataaattactcattaaatcca

SEQ ID NO: 1934 - DNA, 20 bp, Artificial sequence
  Synthetic oligonucleotide
taaattactcattaaatcca

SEQ ID NO: 1935 - DNA, 21 bp, Artificial sequence
  Synthetic oligonucleotide
cataaattactcattaaatcc

SEQ ID NO: 1936 - DNA, 18 bp, Artificial sequence
  Synthetic oligonucleotide
gatttatttttctactta

SEQ ID NO: 1937 - DNA, 21 bp, Artificial sequence
  Synthetic oligonucleotide
atacaacaaacaattcacttt

SEQ ID NO: 1938 - DNA, 19 bp, Artificial sequence
  Synthetic oligonucleotide
cgatacaacaaacaattca

SEQ ID NO: 1939 - DNA, 20 bp, Artificial sequence
  Synthetic oligonucleotide
gaacatccacactaacaaca

SEQ ID NO: 1940 - DNA, 18 bp, Artificial sequence
  Synthetic oligonucleotide
acatccacactaacaaca

SEQ ID NO: 1941 - DNA, 19 bp, Artificial sequence
  Synthetic oligonucleotide
gaacatccacactaacaac

SEQ ID NO: 1942 - DNA, 19 bp, Artificial sequence
  Synthetic oligonucleotide
tgaacatccacactaacaa

SEQ ID NO: 1943 - DNA, 19 bp, Artificial sequence
  Synthetic oligonucleotide
ttgaacatccacactaaca

SEQ ID NO: 1944 - DNA, 18 bp, Artificial sequence
  Synthetic oligonucleotide
tgaacatccacactaaca

SEQ ID NO: 1945 - DNA, 18 bp, Artificial sequence
  Synthetic oligonucleotide
cattgaacatccacacta

SEQ ID NO: 1946 - DNA, 17 bp, Artificial sequence
  Synthetic oligonucleotide
attgaacatccacacta

SEQ ID NO: 1947 - DNA, 17 bp, Artificial sequence
  Synthetic oligonucleotide
cattgaacatccacact

SEQ ID NO: 1948 - DNA, 17 bp, Artificial sequence
  Synthetic oligonucleotide
actcattgaacatccac

SEQ ID NO: 1949 - DNA, 20 bp, Artificial sequence
  Synthetic oligonucleotide
tatctttatttaataatctt

SEQ ID NO: 1950 - DNA, 17 bp, Artificial sequence
  Synthetic oligonucleotide
tctcaagcttcactcta

SEQ ID NO: 1951 - DNA, 19 bp, Artificial sequence
  Synthetic oligonucleotide
gacaatatattcctcaatc

SEQ ID NO: 1952 - DNA, 18 bp, Artificial sequence
  Synthetic oligonucleotide
gacaatatattcctcaat

SEQ ID NO: 1953 - DNA, 17 bp, Artificial sequence
  Synthetic oligonucleotide
tcctgtaacaattatac

SEQ ID NO: 1954 - DNA, 18 bp, Artificial sequence
  Synthetic oligonucleotide
acccagaataaaaaccac

SEQ ID NO: 1955 - DNA, 18 bp, Artificial sequence
  Synthetic oligonucleotide
ttccactttcttactccc

SEQ ID NO: 1956 - DNA, 17 bp, Artificial sequence
  Synthetic oligonucleotide
ttccactttcttactcc

SEQ ID NO: 1957 - DNA, 18 bp, Artificial sequence
  Synthetic oligonucleotide
tttccactttcttactcc

SEQ ID NO: 1958 - DNA, 17 bp, Artificial sequence
  Synthetic oligonucleotide
tttccactttcttactc

SEQ ID NO: 1959 - DNA, 17 bp, Artificial sequence
  Synthetic oligonucleotide
atccctttaccactttt

SEQ ID NO: 1960 - DNA, 18 bp, Artificial sequence
  Synthetic oligonucleotide
catccctttaccactttt

SEQ ID NO: 1961 - DNA, 18 bp, Artificial sequence
  Synthetic oligonucleotide
tcatccctttaccacttt

SEQ ID NO: 1962 - DNA, 17 bp, Artificial sequence
  Synthetic oligonucleotide
tcatccctttaccactt

SEQ ID NO: 1963 - DNA, 18 bp, Artificial sequence
  Synthetic oligonucleotide
ctcatccctttaccactt

SEQ ID NO: 1964 - DNA, 16 bp, Artificial sequence
  Synthetic oligonucleotide
gtctacatctaacccc

SEQ ID NO: 1965 - DNA, 17 bp, Artificial sequence
  Synthetic oligonucleotide
agtctacatctaacccc

SEQ ID NO: 1966 - DNA, 18 bp, Artificial sequence
  Synthetic oligonucleotide
cagtctacatctaacccc

SEQ ID NO: 1967 - DNA, 17 bp, Artificial sequence
  Synthetic oligonucleotide
cagtctacatctaaccc

SEQ ID NO: 1968 - DNA, 18 bp, Artificial sequence
  Synthetic oligonucleotide
tcagtctacatctaaccc

SEQ ID NO: 1969 - DNA, 16 bp, Artificial sequence
  Synthetic oligonucleotide
agtctacatctaaccc

SEQ ID NO: 1970 - DNA, 17 bp, Artificial sequence
  Synthetic oligonucleotide
tcagtctacatctaacc

SEQ ID NO: 1971 - DNA, 18 bp, Artificial sequence
  Synthetic oligonucleotide
ttcagtctacatctaacc

SEQ ID NO: 1972 - DNA, 17 bp, Artificial sequence
  Synthetic oligonucleotide
ttcagtctacatctaac

SEQ ID NO: 1973 - DNA, 17 bp, Artificial sequence
  Synthetic oligonucleotide
tttcagtctacatctaa

SEQ ID NO: 1974 - DNA, 19 bp, Artificial sequence
  Synthetic oligonucleotide
agttttaaccacacctcct

SEQ ID NO: 1975 - DNA, 17 bp, Artificial sequence
  Synthetic oligonucleotide
gttttaaccacacctcc

SEQ ID NO: 1976 - DNA, 18 bp, Artificial sequence
  Synthetic oligonucleotide
agttttaaccacacctcc

SEQ ID NO: 1977 - DNA, 17 bp, Artificial sequence
  Synthetic oligonucleotide
agttttaaccacacctc

SEQ ID NO: 1978 - DNA, 16 bp, Artificial sequence
  Synthetic oligonucleotide
gagttttaaccacacc

SEQ ID NO: 1979 - DNA, 18 bp, Artificial sequence
  Synthetic oligonucleotide
cagatcttctctttattt

SEQ ID NO: 1980 - DNA, 19 bp, Artificial sequence
  Synthetic oligonucleotide
tgttttcaacaaaacatca

SEQ ID NO: 1981 - DNA, 18 bp, Artificial sequence
  Synthetic oligonucleotide
tgttttcaacaaaacatc

SEQ ID NO: 1982 - DNA, 18 bp, Artificial sequence
  Synthetic oligonucleotide
ctgttttcaacaaaacat

SEQ ID NO: 1983 - DNA, 18 bp, Artificial sequence
  Synthetic oligonucleotide
tctgttttcaacaaaaca

SEQ ID NO: 1984 - DNA, 18 bp, Artificial sequence
  Synthetic oligonucleotide
atctttctaaaacttacc

SEQ ID NO: 1985 - DNA, 18 bp, Artificial sequence
  Synthetic oligonucleotide
cagaatctttctaaaact

SEQ ID NO: 1986 - DNA, 17 bp, Artificial sequence
  Synthetic oligonucleotide
ctacagaatctttctaa

SEQ ID NO: 1987 - DNA, 19 bp, Artificial sequence
  Synthetic oligonucleotide
atttccctttatttccctt

SEQ ID NO: 1988 - DNA, 18 bp, Artificial sequence
  Synthetic oligonucleotide
gtatttccctttatttcc

The invention claimed is:

1. An antisense oligonucleotide consisting of ACCcatat-tttactCTT (Compound No 1856_1 (SEQ ID NO: 1856)), wherein a capital letter represents a beta-D-oxy LNA nucleoside, a lower case letter represents a DNA nucleoside, wherein each LNA cytosine is 5-methyl cytosine, and wherein the internucleoside linkages between the nucleosides are phosphorothioate internucleoside linkages; or a pharmaceutically acceptable salt thereof.

2. An antisense oligonucleotide consisting of CTGta-cacttttacaTT (Compound No 1813_1 (SEQ ID NO: 1813)), wherein a capital letter represents a beta-D-oxy LNA nucleoside, a lower case letter represents a DNA nucleoside, wherein each LNA cytosine is 5-methyl cytosine, and wherein the internucleoside linkages between the nucleosides are phosphorothioate internucleoside linkages; or a pharmaceutically acceptable salt thereof.

3. An antisense oligonucleotide consisting of TGtacacttt-tacatTCC (Compound No 1812_1 (SEQ ID NO: 1812)), wherein a capital letter represents a beta-D-oxy LNA nucleoside, a lower case letter represents a DNA nucleoside, wherein each LNA cytosine is 5-methyl cytosine, and wherein the internucleoside linkages between the nucleosides are phosphorothioate internucleoside linkages; or a pharmaceutically acceptable salt thereof.

4. An anti sense oligonucleotide consisting of Gtacacttt-tacattCCC (Compound No 1809_2 (SEQ ID NO: 1809)), wherein a capital letter represents a beta-D-oxy LNA nucleoside, a lower case letter represents a DNA nucleoside, wherein each LNA cytosine is 5-methyl cytosine, and wherein the internucleoside linkages between the nucleosides are phosphorothioate internucleoside linkages; or a pharmaceutically acceptable salt thereof.

5. An antisense oligonucleotide consisting of TTCttcat-tataccatCAA (Compound No 1607_1 (SEQ ID NO: 1607)), wherein a capital letter represents a beta-D-oxy LNA nucleoside, a lower case letter represents a DNA nucleoside, wherein each LNA cytosine is 5-methyl cytosine, and wherein the internucleoside linkages between the nucleosides are phosphorothioate internucleoside linkages; or a pharmaceutically acceptable salt thereof.

6. An antisense oligonucleotide consisting of AatCtTatt-tacatcTtCC (Compound No 1122_62 (SEQ ID NO: 1122)), wherein a capital letter represents a beta-D-oxy LNA nucleoside, a lower case letter represents a DNA nucleoside, wherein each LNA cytosine is 5-methyl cytosine, and wherein the internucleoside linkages between the nucleosides are phosphorothioate internucleoside linkages; or a pharmaceutically acceptable salt thereof.

7. An antisense oligonucleotide consisting of AATCttat-ttacatcTtCC (Compound No 1122_67 (SEQ ID NO: 1122)), wherein a capital letter represents a beta-D-oxy LNA nucleoside, a lower case letter represents a DNA nucleoside, wherein each LNA cytosine is 5-methyl cytosine, and wherein the internucleoside linkages between the nucleosides are phosphorothioate internucleoside linkages; or a pharmaceutically acceptable salt thereof.

8. An antisense oligonucleotide consisting of AatCtTatt-tacatctTCC (Compound No 1122_33 (SEQ ID NO: 1122)), wherein a capital letter represents a beta-D-oxy LNA nucleoside, a lower case letter represents a DNA nucleoside, wherein each LNA cytosine is 5-methyl cytosine, and wherein the internucleoside linkages between the nucleosides are phosphorothioate internucleoside linkages; or a pharmaceutically acceptable salt thereof.

9. A conjugate comprising the oligonucleotide according to claim 2, and at least one conjugate moiety covalently attached to said oligonucleotide; or a pharmaceutically acceptable salt thereof.

10. A pharmaceutical composition comprising the oligonucleotide of claim 2, and a pharmaceutically acceptable diluent, solvent, carrier, salt and/or adjuvant.

11. An in vivo or in vitro method for modulating ATXN3 expression in a target cell which is expressing ATXN3, said method comprising administering an oligonucleotide or salt of claim 2, in an effective amount to said cell.

12. A method for treating or preventing a disease comprising administering a therapeutically or prophylactically effective amount of an oligonucleotide or salt of claim 2, to a subject suffering from or susceptible to the disease.

13. The method of claim 12, wherein the disease is spinocerebellar ataxia, such as spinocerebellar ataxia 3 or Machado-Joseph disease (MJD).

14. The oligonucleotide or salt of claim 2, for use in medicine.

15. The oligonucleotide or salt of claim 2, for use in the treatment or prevention of spinocerebellar ataxia, such as spinocerebellar ataxia 3 or Machado-Joseph disease (MJD).

* * * * *